(12) United States Patent
Cohen et al.

(10) Patent No.: US 7,345,142 B2
(45) Date of Patent: Mar. 18, 2008

(54) NUCLEOTIDE AND AMINO ACID SEQUENCES, AND ASSAYS AND METHODS OF USE THEREOF FOR DIAGNOSIS OF CARDIAC DISEASE

(75) Inventors: Yossi Cohen, Banstead (GB); Alexander Diber, Rishon-LeZion (IL); Amir Toporik, Azur (IL); Sarah Pollock, Tel-Aviv (IL); Zurit Levine, Herzlia (IL); Michal Ayalon-Soffer, Ramat-HaSharon (IL); Gad S. Cojocaru, Ramat-HaSharon (IL); Amit Novik, Beit-HaSharon (IL); Guy Kol, Givat Shmuel (IL); Osnat Sella-Tavor, Kfar Kish (IL); Shira Walach, Hod-HaSharon (IL); Shirley Sameah-Greenwald, Kfar-Saba (IL); Dvir Dahary, Tel-Aviv (IL); Ronen Shemesh, Modiln (IL)

(73) Assignee: Compugen Ltd., Tel Aviv (IL)

( * ) Notice: Subject to any disclaimer, the term of this patent is extended or adjusted under 35 U.S.C. 154(b) by 0 days.

(21) Appl. No.: 11/043,824

(22) Filed: Jan. 27, 2005

(65) Prior Publication Data

US 2006/0172311 A1    Aug. 3, 2006

Related U.S. Application Data

(60) Provisional application No. 60/620,916, filed on Oct. 22, 2004, provisional application No. 60/628,123, filed on Nov. 17, 2004, provisional application No. 60/621,131, filed on Oct. 25, 2004, provisional application No. 60/628,134, filed on Nov. 17, 2004, provisional application No. 60/622,320, filed on Oct. 27, 2004, provisional application No. 60/628,190, filed on Nov. 17, 2004, provisional application No. 60/630,559, filed on Nov. 26, 2004, provisional application No. 60/539,129, filed on Jan. 27, 2004, provisional application No. 60/539,128, filed on Jan. 27, 2004.

(51) Int. Cl.
*A61K 38/00* (2006.01)

(52) U.S. Cl. ..................................... 530/300

(58) Field of Classification Search ............ None
See application file for complete search history.

(56) References Cited

FOREIGN PATENT DOCUMENTS

| DE | 4243648 | | 7/1994 |
|---|---|---|---|
| WO | WO 00/23585 | * | 4/2000 |
| WO | WO 01/32927 | | 5/2001 |

OTHER PUBLICATIONS

Tockman et al (Cancer Res., 1992, 52:2711s-2718s).*
Sequence comparison.*
PCT Written Opinion Of The International Searching Authority for PCT/IB2005/001306 (In English).
Isolation and Characterization of the Human Cardiac Troponin I Gene (TNNI3), Bhavsar et al., Article No. 0317, Genomics 35., pp. 11-23 (1996) (In English).
Thin-filament-binding domains of cardiac and fast skeletal muscle troponin I isoforms as studied by epitope tagging, Toyota et al., Journal of Muscle Research and Cell Motility, 20:755-760, 1999 (in English).
Alu-Containing Exons are Alternatively Spliced, Sorek et al., Department of Zoology, pp. 1060-1067 (in English).
XP-002366938 BQ230791 standard, National Institutes of Health, Mammalian Gene Collection, Contact: Dr. Robert Strausberg (1 pg.) (in English).
PCT Preliminary Report on Patentability dated Aug. 3, 2006 for PCT Application No. PCT/IB2005/001306, In English.

* cited by examiner

*Primary Examiner*—Misook Yu
*Assistant Examiner*—Sean E Aeder
(74) *Attorney, Agent, or Firm*—Staas & Halsey LLP

(57) ABSTRACT

Novel markers for cardiac disease that are both sensitive and accurate. These markers are differentially and/or specifically expressed in cardiac tissue, as opposed to other types of tissues, optionally and preferably including muscle tissue. The measurement of these markers, alone or in combination, in patient samples provides information that the diagnostician can correlate with a probable diagnosis of cardiac disease, including pathology and/or damage, including acute and/or chronic damage. The markers of the present invention, alone or in combination, show a high degree of differential detection between cardiac disease states and non-cardiac disease states.

8 Claims, 43 Drawing Sheets

Figure 1: Schematic summary of quantitative real-time PCR analysis.
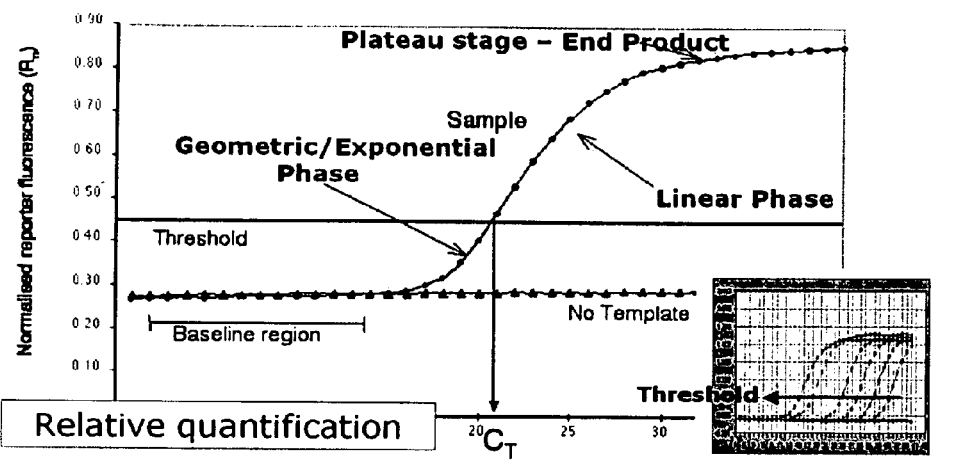
$C_T$ = Threshold Cycle point – A calculated cycle number in which PCR products signal is above the background level (passive dye ROX) and still in the Geometric/Expo phase.
Figure 2 - Expression of ESTs in each category, as "parts per million"
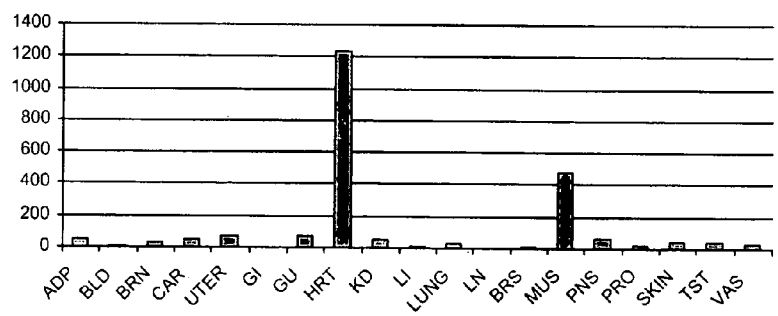

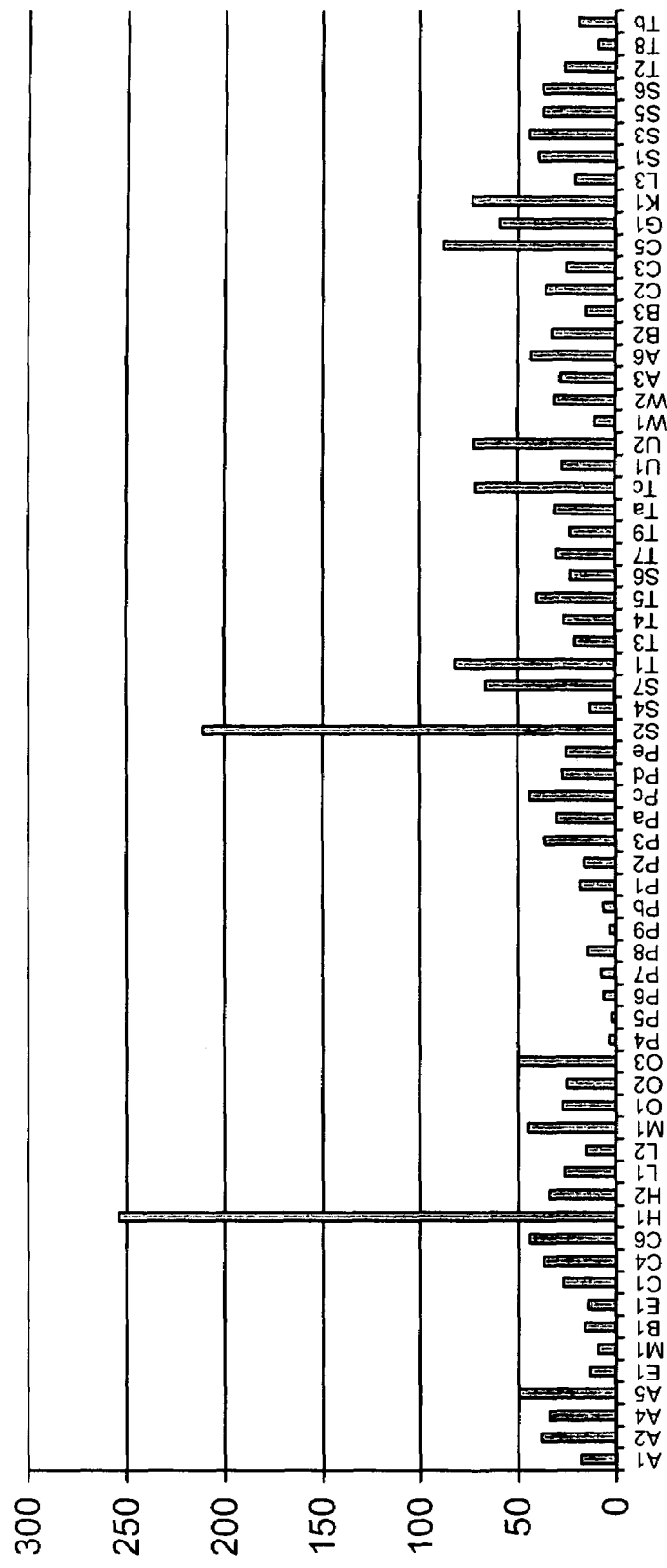
Figure 3 - Expression of oligonucleotides in various tissues, prob 205738_s_at

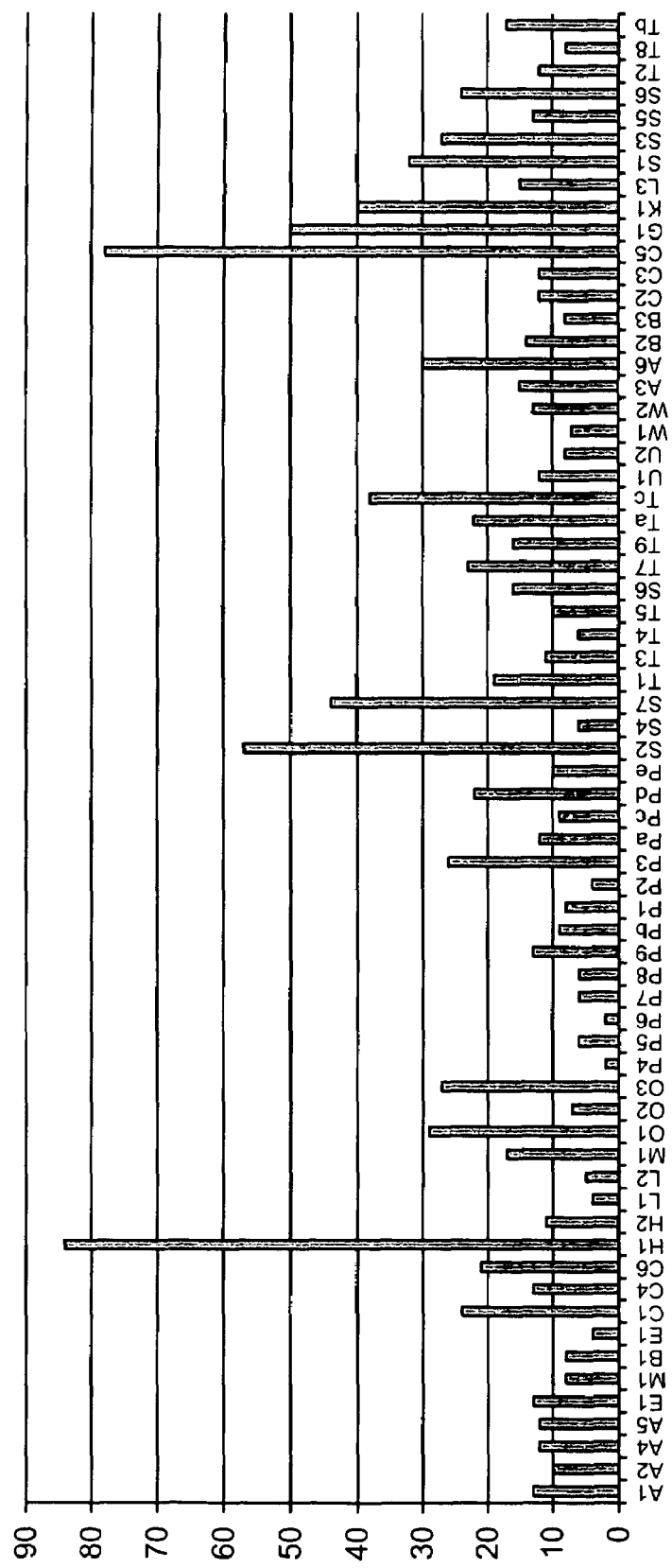
Figure 4 - Expression of oligonucleotides in various tissues, prob 214285_at Figure 7 - Expression of ESTs in each category, as "parts per million"

Figure 8 - Expression of oligonucleotides in various tissues, prob 207317_s_at

Figure 11 - Expression of ESTs in each category, as "parts per million"

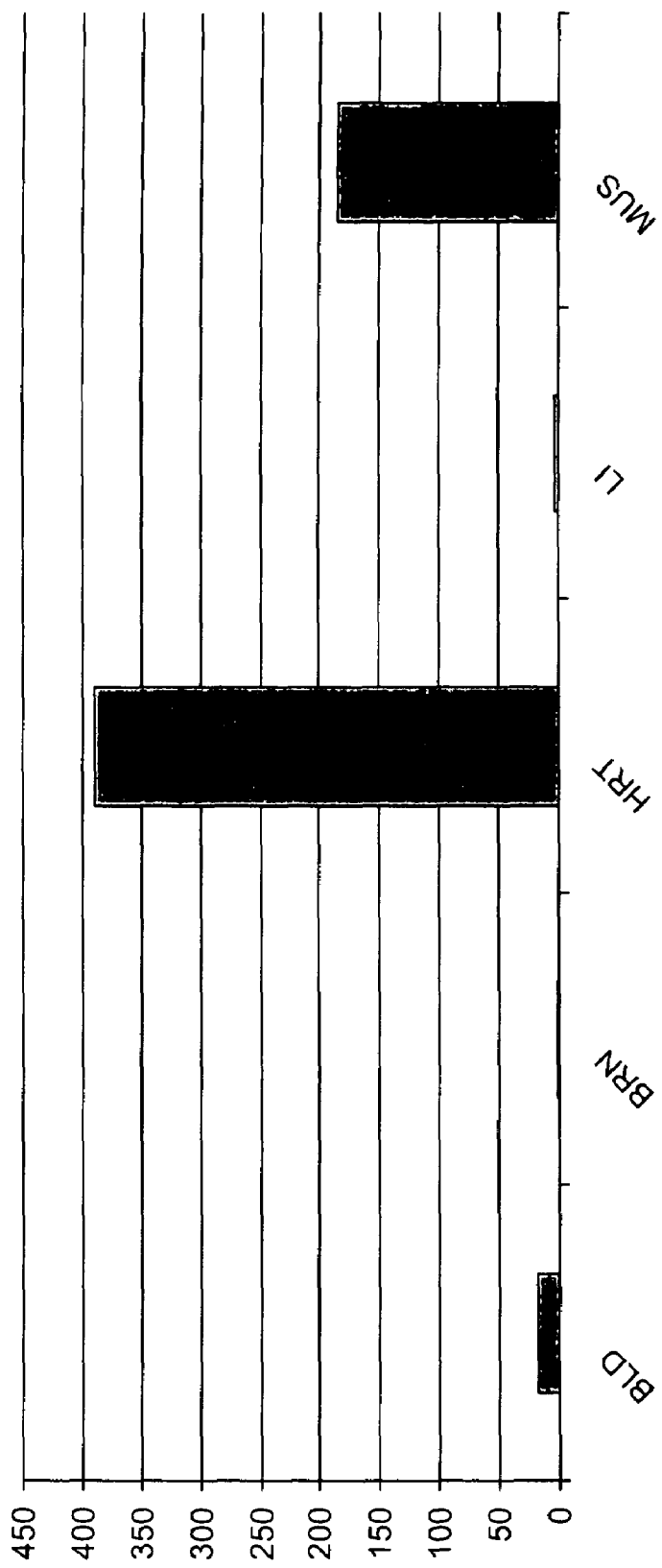
Figure 15 - Expression of ESTs in each category, as "parts per million"

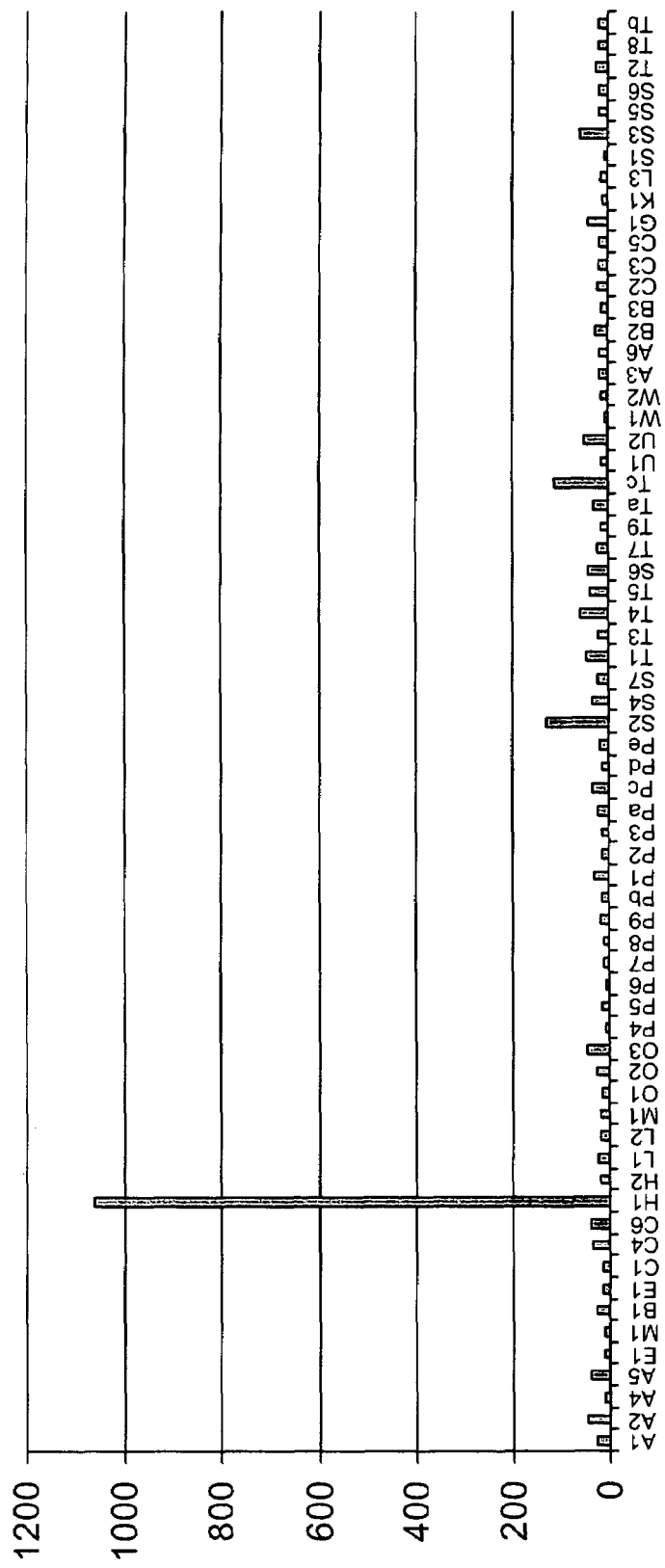
Figure 16 - Expression of oligonucleotides in various tissues, prob 221051_s_at

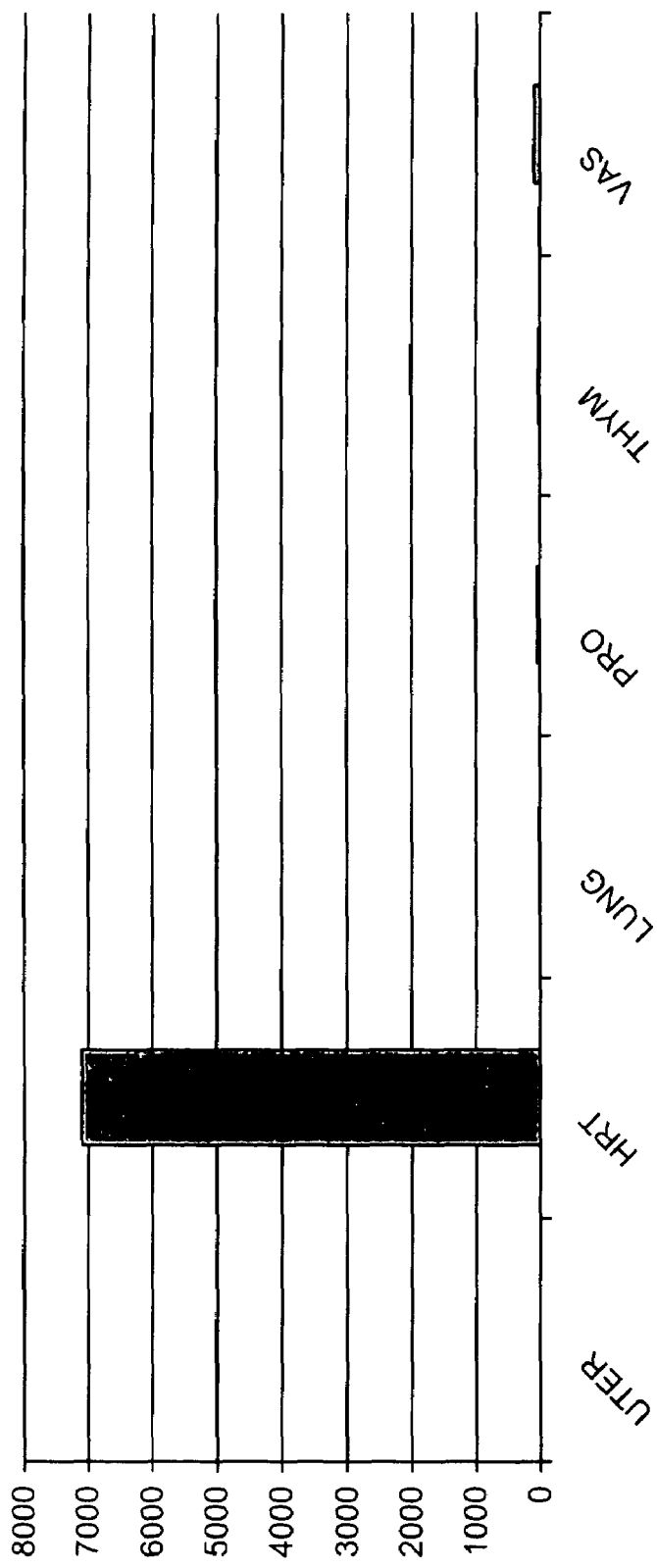

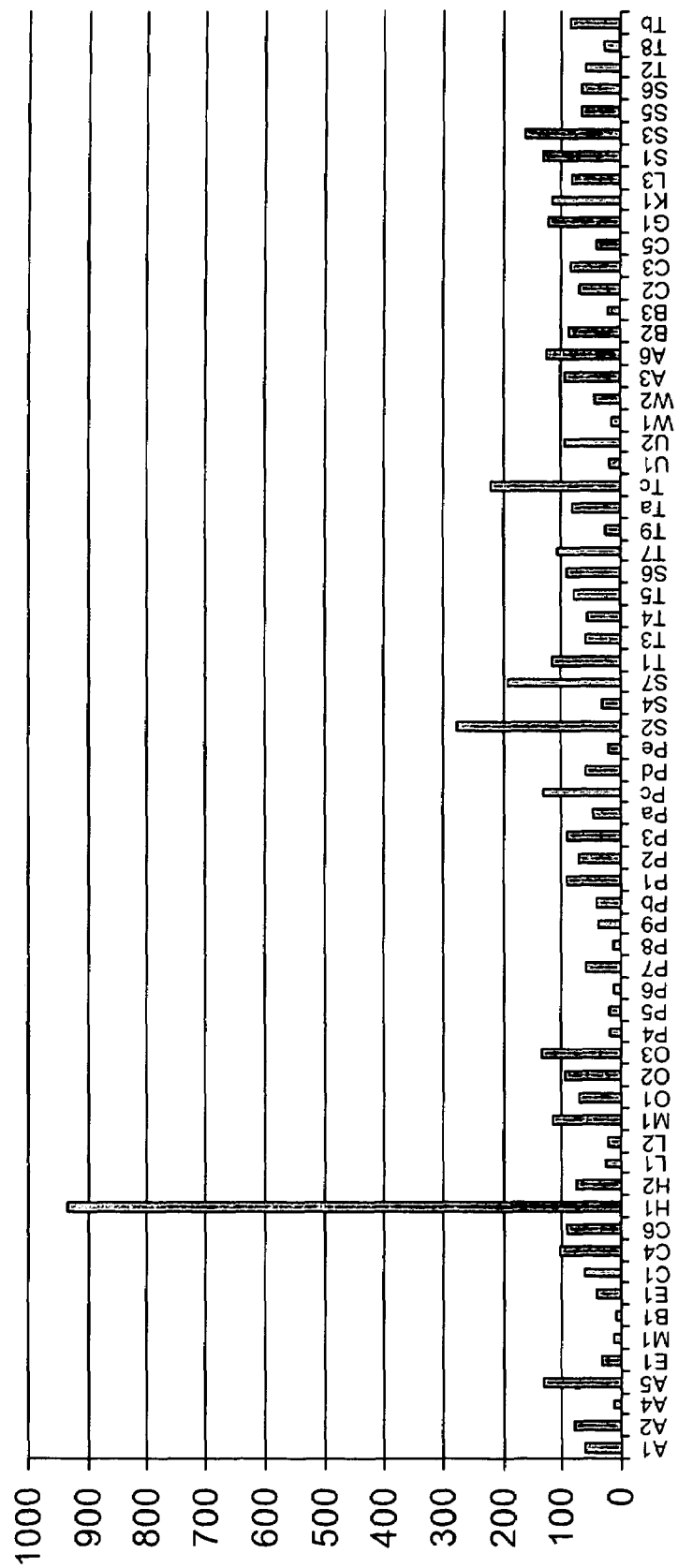
Figure 17B - Expression of oligonucleotides in various tissues, prob 209957_s_at

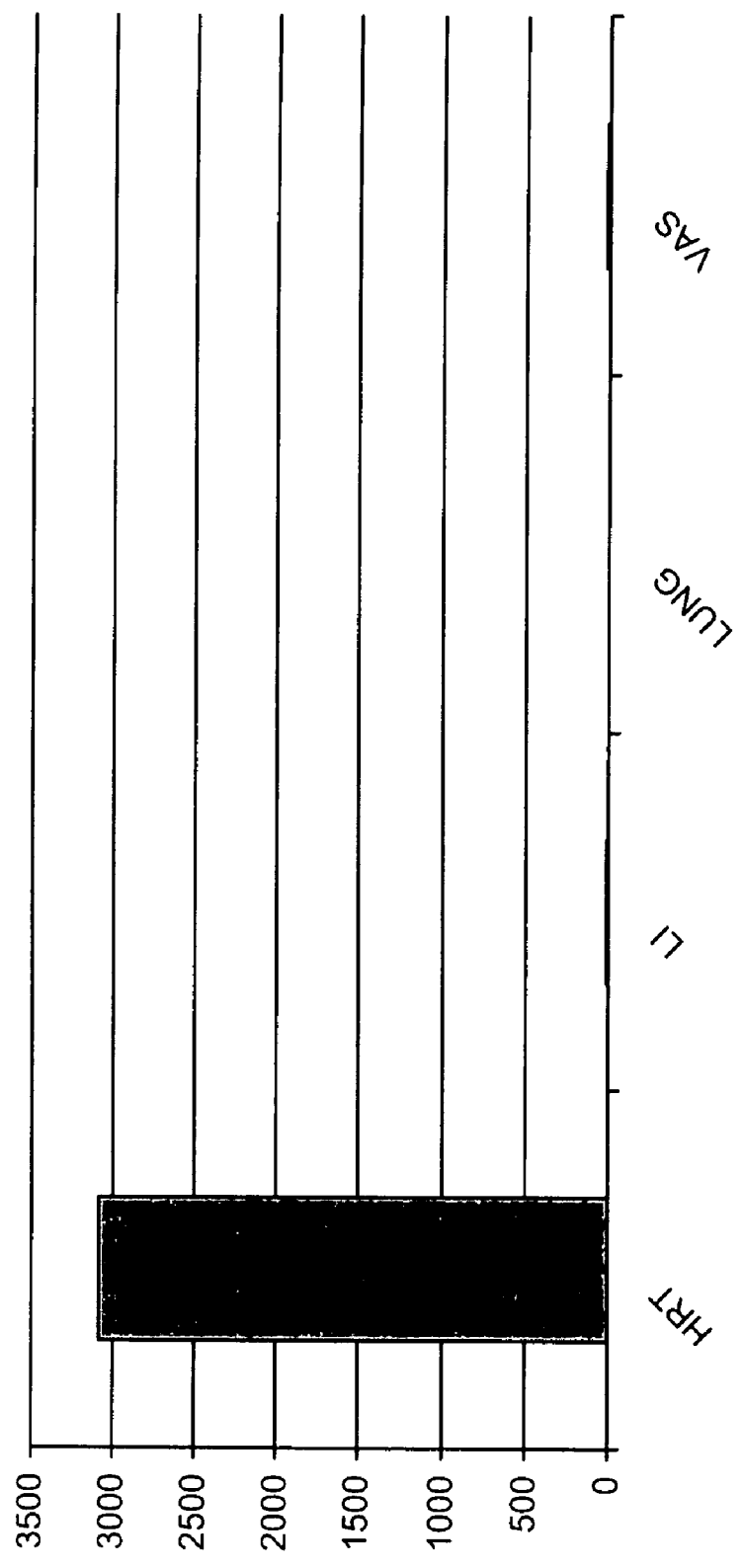
Figure 19 - Expression of ESTs in each category, as "parts per million"

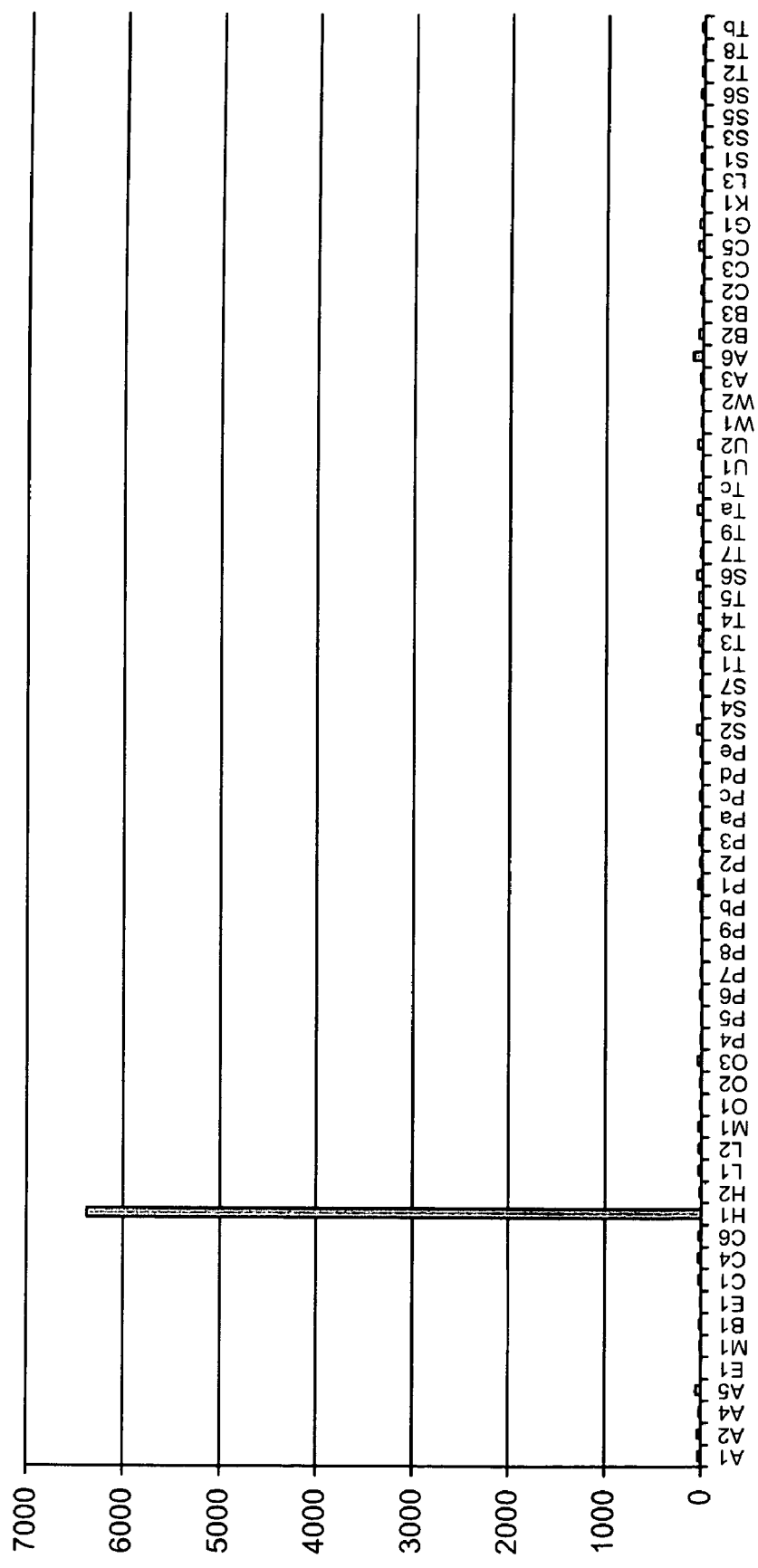
Figure 20 - Expression of oligonucleotides in various tissues, prob 205742_at Figure 23 - Expression of ESTs in each category, as "parts per million"

Figure 24 - Expression of oligonucleotides in various tissues, prob 205295_at

Figure 25 – Expression of ESTs in each category, as "parts per million"

Figure 26 - Expression of oligonucleotides in various tissues, prob 207066_at

Figure 27 - Expression of ESTs in each category, as "parts per million"

Figure 28 - Expression of oligonucleotides in various tissues, prob 206029_at

Figure 29 – Expression of ESTs in each category, as "parts per million"

Figure 30 - Expression of ESTs in each category, as "parts per million"

Figure 31 - Expression of oligonucleotides in various tissues, prob 204737_s_at

Figure 32 - Expression of oligonucleotides in various tissues, prob 216265_x_at

Troponin T7

Figure 35

CCCTCACTGACCCTCCAAACGCCCCTGTCCTCGCCCTGCCTCCTGCCATT
CCCGGCCTGAGTCTCAGCATGGCGGATGGGAGCAGCGATGCGGCTAGG
GAACCTCGCCCTGCACCAGCCCCAATCAGACGCCGCTCCTCCAACTA
CCGCGCTTATGCCACGGAGCCGCACGCCAAGGTGGGACGGGGCTTCC
TGGGGGCAGAGTACAGGCGCCGGAGGGATCCAAGACCCTGGGAGTG
GGGGAGGAGCCAGGGCTGCGAAGGGGGCGGGGACTACGCGGAGG
GGCTTCAGGGGCGGAGTTTTGCAGAGGGTCATGCTCGGATTGGTGAC
AGCAGCCTGCGGGCGGAACTCCGTTGCCCTCGGACTTGCTTAGGGATAG
ATGGGAAG

In Red- Trop Forward primer
In Blue- Trop Reverse complementary sequence
Highlighted sequence- Troponin vari

Figure 37

DNA sequence of HisTroponin T7 pRSETA bold- HisTroponin T7 open reading frame

*Italic- flanking DNA sequence which was verified by sequence analysis*

*GATCTCGATCCCGCGAAATTAATACGACTCACTATAGGGAGACCACAACGGT TTCCC*
*TCTAGAAATAATTTTGTTTAACTTTAAGAAGGAGATATACA* TATGCGGGGTTCTCAT
CATCATCATCATCATGGTATGGCTAGCATGGCGGATGGGAGCAGCGATGCGGCTAGG
GAACCTCGCCCTGCACCAGCCCCAATCAGACGCCGCTCCTCCAACTACCGCGCTTAT
GCCACGGAGCCGCACGCCAAGGTGGGACGGGGCTTCCTGGGGGCAGAGTACAGGCGC
CGGAGGGATCCAAGACCCTGGGAGTGGGGGGAGGAGCCAGGGCTGCGAAGGGGCGG
GGACTACGCGGAGGGGCTTCAGGGGCGGAGTTTTGCAGAGGGTCATGCTCGGATTGG
TGA*AGCTTGATCCGGCTGCTAACAAAGCCCGAAAGGAAGCTGAGTTGGCTGCTGCCA*
*CCGCTGAGCAATAACTAGCATAACCCCTTGGGGCCTCTAAACGGGTCTTGAGGGGTT*
*TTTTGCTGAAAGGAGGAACTATATCCGGATCTGGCGTAATAGCGAAGAGGCCCGCAC*
*CGATCGCCCTTCCCAACAGTTGCGCAGCCTGAATGGCGAATGGGACGCGCCCTGTAG*
*CGGCGCATTAAGCGCGGCGGGTGTGGTGGTTACGCGCAGCGTGACCGCTACACTTGC*
*CAGCGCCCTAGCGCCCGCTCCTTTCGCTTTCTTCCCTTCCTTTCTCGCCACGTTCGC*
*CGGCTTTCCCCGTCAAGCTCTAAATCGGGGGCTCCCTTTAGGGTTCCGATTTAGTGC*
*TTTACGGCACCTCGACCCCAAAAAACTTGATTAGGGTGATGGTTCACGTAGTGGGCC*
*ATCGCCCTGATAGACGGTTTTTCGCCCTTTGACGTTGGAGTCCACGTTCTTTAATAG*
*TGGACTCTTGTTCCAAACTGGAACAACACTCAACCCTATCTCGGTCTATTCTTTTGA*
*TTTATAAGGGATTTTGCCGATTTCGGCCTATTGGTTAAAAAATGAGCTGATTTAACA*
*AAAATTTAACGCGAATTTTAACAAAATATTAACGCTTACAATTTAGGTGGCACTTTT*
*CGGGGAAATGTGCGCGGAACCCCTATTTGTTTATTTTTCTAAATACATTCAAATATG*

*TATCCGCTCATGAGACAATAACCCTGATAAATGCTTCAATAATATTGAAAAAGGAAG*
*AGTATGAGTATTCAACATTTCCGTGTCGCCCTTATTCCCTTTTTTGCGGCATTTTGC*
*CTTCCTGTTTTTGCTCACCCAGAAACGCTGGTGAAAGTAAAAGATGCTGAAGATCAG*
*TTGGGTGCACGAGTGGGTTACATCGAACTGGATCTCAACAGCGGTAAGATCCTTGAG*
*AGTTTTCGCCCCGAAGAACGTTTTCCAATGATGAGCACTTTTAAAGTTCTGCTATGT*
*GGCGCGGTATTATCCCGTATTGACGCCGGGCAAGAGCAACTCGGTCGCCGCATACAC*
*TATTCTCAGAATGACTTGGTTGAGTACTCACCAGTCACAGAAAAGCATCTTACGGAT*
*GGCATGACAGTAAGAGAATTATGCAGTGCTGCCATAACCATGAGTGATAACACTGCG*

Figure 37 Continued

GCCAACTTACTTCTGACAACGATCGGAGGACCGAAGGAGCTAACCGCTTTTTTGCAC
AACATGGGGGATCATGTAACTCGCCTTGATCGTTGGGAACCGGAGCTGAATGAAGCC
ATACCAAACGACGAGCGTGACACCACGATGCCTGTAGCAATGGCAACAACGTTGCGC
AAACTATTAACTGGCGAACTACTTACTCTAGCTTCCCGGCAACAATTAATAGACTGG
ATGGAGGCGGATAAAGTTGCAGGACCACTTCTGCGCTCGGCCCTTCCGGCTGGCTGG
TTTATTGCTGATAAATCTGGAGCCGGTGAGCGTGGGTCTCGCGGTATCATTGCAGCA
CTGGGGCCAGATGGTAAGCCCTCCCGTATCGTAGTTATCTACACGACGGGGAGTCAG
GCAACTATGGATGAACGAAATAGACAGATCGCTGAGATAGGTGCCTCACTGATTAAG
CATTGGTAACTGTCAGACCAAGTTTACTCATATATACTTTAGATTGATTTAAAACTT
CATTTTTAATTTAAAAGGATCTAGGTGAAGATCCTTTTTGATAATCTCATGACCAAA
ATCCCTTAACGTGAGTTTTCGTTCCACTGAGCGTCAGACCCCGTAGAAAAGATCAAA
GGATCTTCTTGAGATCCTTTTTTCTGCGCGTAATCTGCTGCTTGCAAACAAAAAAA
CCACCGCTACCAGCGGTGGTTTGTTTGCCGGATCAAGAGCTACCAACTCTTTTTCCG
AAGGTAACTGGCTTCAGCAGAGCGCAGATACCAAATACTGTTCTTCTAGTGTAGCCG
TAGTTAGGCCACCACTTCAAGAACTCTGTAGCACCGCCTACATACCTCGCTCTGCTA
ATCCTGTTACCAGTGGCTGCTGCCAGTGGCGATAAGTCGTGTCTTACCGGGTTGGAC
TCAAGACGATAGTTACCGGATAAGGCGCAGCGGTCGGGCTGAACGGGGGGTTCGTGC
ACACAGCCCAGCTTGGAGCGAACGACCTACACCGAACTGAGATACCTACAGCGTGAG
CTATGAGAAAGCGCCACGCTTCCCGAAGGGAGAAAGGCGGACAGGTATCCGGTAAGC
GGCAGGGTCGGAACAGGAGAGCGCACGAGGGAGCTTCCAGGGGGAAACGCCTGGTAT
CTTTATAGTCCTGTCGGGTTTCGCCACCTCTGACTTGAGCGTCGATTTTGTGATGC
TCGTCAGGGGGCGGAGCCTATGGAAAAACGCCAGCAACGCGGCCTTTTTACGGTTC
CTGGCCTTTTGCTGGCCTTTTGCTCACATGTTCTTTCCTGCGTTATCCCCTGATTCT
GTGGATAACCGTATTACCGCCTTTGAGTGAGCTGATACCGCTCGCCGCAGCCGAACG
ACCGAGCGCAGCGAGTCAGTGAGCGAGGAAGCGGAAGAGCGCCCAATACGCAAACCG
CCTCTCCCCGCGCGTTGGCCGATTCATTAATGCAG

Figure 38

MRGSHHHHHHHHHGMASMADGSSDAAREPRPAPAPIRRRSSNYRAYATEPHAKV
GRGFLGAEYRRRRDPRPWEWGEEPGLRRGRGLRGGASGAEFCRGSCSDW

In red- 6 His tag
In blue- Troponin

NUCLEOTIDE AND AMINO ACID SEQUENCES, AND ASSAYS AND METHODS OF USE THEREOF FOR DIAGNOSIS OF CARDIAC DISEASE

CROSS-REFERENCE TO RELATED APPLICATION(S)

This application is related to Novel Nucleotide and Amino Acid Sequences, and Assays and Methods of use thereof for Diagnosis of Cardiac Disease, and claims priority to the below U.S. provisional applications which are incorporated by reference herein:
Application No. 60/620,916 filed Oct. 22, 2004—Differential Expression of Markers in Colon Cancer
Application No. 60/628,123 filed Nov. 17, 2004—Differential Expression of Markers in Colon Cancer II
Application No. 60/621,131 filed Oct. 25, 2004—Diagnostic Markers for Colon Cancer, and Assays and Methods of use thereof.
Application No. 60/628,134 filed Nov. 17, 2004—Differential Expression of Markers in Ovarian Cancer II
Application No. 60/622,320 filed Oct. 27, 2004—Diagnostic Markers for Cardiac Disease and/or Pathological Conditions, and Assays and methods of Use thereof.
Application No. 60/628,190 filed Nov. 17, 2004—Diagnostic Markers for Cardiac Disease and/or Pathological Conditions, and Assays and Methods of Use thereof II
Application No. 60/630,559 filed Nov. 26, 2004—Diagnostic Markers for Cardiac Disease and/or Pathological Conditions, and Assays and Methods of Use thereof II
Application No. 60/539,129 filed Jan. 27, 2004—Methods and Systems for Annotating Biomolecular Sequences
Application No. 60/539,128 filed Jan. 27, 2004—Evolutionary Conserved Spliced Sequences and Methods and Systems for Identifying thereof

FIELD OF THE INVENTION

The present invention is related to novel nucleotide and protein sequences that are diagnostic markers for cardiac disease and/or pathological conditions, including cardiac damage, and assays and methods of use thereof.

BACKGROUND OF THE INVENTION

Cardiovascular diseases are an important cause of mortality and morbidity. Amongst all age groups considered, IHD is the most common cause of death not only in men but also in women. Coronary atherosclerosis is a chronic progressing process, associated with angina type symptoms and frequently result in Acute Myocardial Infarction (AMI). The diagnosis is achieved with a combination of patient physical examination, ECG since 1950's molecular markers play the most important role in the differential diagnosis of AMI from other conditions with similar symptoms. Early diagnosis is mandatory of the establishment of early treatment (including blood diluting agents, thrombolysis, catheterization and surgery).

Early molecular markers for AMI were SGOT and LDH were proved to be of very low specificity and are hardly being used at present. These markers were replaced by CPK, and later on by the heart specific CPK-MB variant. Its specificity is better than for SGOT and LDH, it is still limited both in specificity and sensitivity which reach only 67% when used together with electrocardiogram. In addition, cardiac surgery, myocarditis, and electrical cardioversion often result in elevated serum levels of the CPK-MB isoenzyme. Small infarct with minor myocardial cell necrosis often do not increase serum CPK-MB to a detected level. Myoglobin is another heart damage low molecular (17 kD) protein but is even less specific to heart muscle compared with CPK-MB. Its advantage over CPK-MB is a rapid rise from the onset of symptoms—usually between 3-6 hours. It is considered one of the earliest indicators (together with H-FABP) but it lacks specificity due to significant expression in skeletal muscle—its concentration is approximately two-fold lower in cardiac than skeletal muscle and the leads to seriously diminished specificity.

Cardiac troponins are currently the routine serum cardiac markers used for the diagnosis of AMI. Troponin-I and Troponin-T have amino acid sequences different from those of the skeletal muscle called cTnT and cTnI (cardiac Troponin-T and I recpectively). Cardiac troponins are not found in the serum of healthy individuals and rise to up to 20 times above a predefined cut-off level, therefore are very useful and sensitive in the detection of cardiac damage. They are capable of detecting very small cardiac damage—microinfarction, it is associated with a very adverse longer term prognosis. Cardiac troponin's sensitivity is considerably higher than CPK-MB but they suffer from a few disadvantages: 1. They are not early markers—cTnI and cTnT reach peak serum value in about 12 and 48 hours respectively after symptoms onset. 2. Levels of cTnI and cTnT remain elevated for up to 10 days and 14 days respectively after AMI, therefore cannot be used for the detection of re-infarction. 3. Other heart diseases such as Congestive Heart Failure and Myocarditis can increase troponins concentrations in the serum. The lack of specificity for AMI is an advantage when there are other supporting clinical evidence directing the doctor towards another diagnosis. Troponins might have a diagnostic value in assessing myocardial damage after coronary artery perfusion, monitoring progression and prognosis of unstable angina, in the detection and prognosis of cardiac contusion after blunt trauma, detecting myocarditis.

The heart specific variant H-FABP (Heart Fatty Acid binding protein) is a low molecular protein (15 Kd) soluble non-enzyme protein. H-FABP concentration in the heart muscle is greater than that in skeletal muscle, and its normal baseline concentration is several fold lower than myoglobin. In addition, it reaches peak value in the urine and blood early, within 2-3 hours from AMI. Within a period of 30-210 minutes after symptoms started, H-FABP has higher sensitivity—up to 80%—when compared with other cardiac markers (CPK-MB and the troponins sensitivity were reported to be 64% in the first 6 hours after AMI). Yet, H-FABP still misses every $5^{th}$ patient in this time scale. H-FABP has other limitations as well, including 1. rising in the plasma after exercise 2. released from muscle in skeletal damage during the course of AMI (like from intramuscular injections) 3. reduced clearance in renal failure situations.

The search for novel cardiac damage markers is ongoing. Other proteins are under trials for that purpose including glycogen phosphorylase BB, HIF and VEGF 21.

SUMMARY OF THE INVENTION

Markers for the cardiac disease and/or cardiac pathology, including but not limited to cardiac damage in the prior art are not sufficiently sensitive and/or accurate, alone or in combination.

The present invention overcomes these deficiencies of the background art by providing novel markers for cardiac disease and/or cardiac pathology, including but not limited to cardiac damage that are both sensitive and accurate. Optionally and preferably, these markers are detected in a biological sample.

According to preferred embodiments of the present invention, cardiac disease and/or pathology and/or condition and/or disorder may comprise one or more of Myocardial infarct, acute coronary syndrome, angina pectoris (stable and unstable), cardiomyopathy, myocarditis, congestive heart failure or any type of heart failure, the detection of reinfarction, the detection of success of thrombolytic therapy after Myocardial infarct, Myocardial infarct after surgery, assessing the size of infarct in Myocardial infarct, the differential diagnosis of heart related conditions from lung related conditions (as pulmonary embolism), the differential diagnosis of Dyspnea, and cardiac valves related conditions.

According to preferred embodiments of the present invention, examples of suitable biological samples include but are not limited to blood, serum, plasma, blood cells, urine, sputum, saliva, stool, spinal fluid, lymph fluid, the external secretions of the skin, respiratory, intestinal, and genitourinary tracts, tears, milk, neuronal tissue, and any human organ or tissue. In a preferred embodiment, the biological sample comprises cardiac tissue and/or a serum sample and/or a urine sample and/or any other tissue or liquid sample. The sample can optionally be diluted with a suitable eluant before contacting the sample to the antibody.

Information given in the text with regard to cellular localization was determined according to four different software programs: (i) tmhmm (from Center for Biological Sequence Analysis, Technical University of Denmark DTU, dot cbs dtu dot dk/services/TMHMM/TMHMM2 dot 0b dot guide dot php) or (ii) tmpred (from EMBnet, maintained by the ISREC Bionformatics group and the LICR Information Technology Office, Ludwig Institute for Cancer Research, Swiss Institute of Bioinformatics, dot ch dot embnet dot org/software/TMPRED_form dot html) for transmembrane region prediction; (iii) signalp_hmm or (iv) signalp_nn (both from Center for Biological Sequence Analysis, Technical University of Denmark DTU, dot cbs dot dtu dot dk/services/SignalP/background/prediction dot php) for signal peptide prediction. The terms "signalp_hmm" and "signalp_.mu.nn" refer to two modes of operation for the program SignalP: hmm refers to Hidden Markov Model, while nn refers to neural networks. Localization was also determined through manual inspection of known protein localization and/or gene structure, and the use of heuristics by the individual inventor. In some cases for the manual inspection of cellular localization prediction inventors used the ProLoc computational plafform [Einat Hazkani-Covo, Erez Levanon, Galit Rotman, Dan Graur and Amit Novik; (2004) "Evolution of multicellularity in metazoa: comparative analysis of the subcellular localization of proteins in *Saccharomyces, Drosophila and Caenorhabditis*." Cell Biology International 2004; 28(3):171-8.], which predicts protein localization based on various parameters including, protein domains (e.g., prediction of trans-membranous regions and localization thereof within the protein), pl, protein length, amino acid composition, homology to pre-annotated proteins, recognition of sequence patterns which direct the protein to a certain organelle (such as, nuclear localization signal, NLS, mitochondria localization signal), signal peptide and anchor modeling and using unique domains from Pfam that are specific to a single compartment.

Information is given in the text with regard to SNPs (single nucleotide polymorphisms). A description of the abbreviations is as follows. "T->C", for example, means that the SNP results in a change at the position given in the table from T to C. Similarly, "M->Q", for example, means that the SNP has caused a change in the corresponding amino acid sequence, from methionine (M) to glutamine (Q). If, in place of a letter at the right hand side for the nucleotide sequence SNP, there is a space, it indicates that a frameshift has occurred. A frameshift may also be indicated with a hyphen (–). A stop codon is indicated with an asterisk at the right hand side (*). As part of the description of an SNP, a comment may be found in parentheses after the above description of the SNP itself. This comment may include an FTId, which is an identifier to a SwissProt entry that was created with the indicated SNP. An FTId is a unique and stable feature identifier, which allows construction of links directly from position-specific annotation in the feature table to specialized protein-related databases. The FTId is always the last component of a feature in the description field, as follows: FTId=XXX_number, in which XXX is the 3-letter code for the specific feature key, separated by an underscore from a 6-digit number. In the table of the amino acid mutations of the wild type proteins of the selected splice variants of the invention, the header of the first column is "SNP position(s) on amino acid sequence", representing a position of a known mutation on amino acid sequence.

SNPs may optionally be used as diagnostic markers according to the present invention, alone or in combination with one or more other SNPs and/or any other diagnostic marker. Preferred embodiments of the present invention comprise such SNPs, including but not limited to novel SNPs on the known (WT or wild type) protein sequences given below, as well as novel nucleic acid and/or amino acid sequences formed through such SNPs, and/or any SNP on a variant amino acid and/or nucleic acid sequence described herein.

Information given in the text with regard to the Homology to the known proteins was determined by Smith-Waterman version 5.1.2 using special (non default) parameters as follows:
    model=sw.model
    GAPEXT=0
    GAPOP=100.0
    MATRIX=blosum100

Information is given with regard to overexpression of a cluster in cancer based on microarrays. As a microarray reference, in the specific segment paragraphs, the unabbreviated tissue name was used as the reference to the type of chip for which expression was measured. There are two types of microarray results: those from microarrays prepared according to a design by the present inventors, for which the microarray fabrication procedure is described in detail in Materials and Experimental Procedures section herein; and those results from microarrays using Affymetrix technology. As a microarray reference, in the specific segment paragraphs, the unabbreviated tissue name was used as the reference to the type of chip for which expression was measured. For microarrays prepared according to a design by the present inventors, the probe name begins with the name of the cluster (gene), followed by an identifying number. Oligonucleotide microarray results taken from Affymetrix data were from chips available from Affymetrix Inc, Santa Clara, Calif., USA (see for example data regarding the Human Genome U133 (HG-U133) Set at dot affymetrix dot com/products/arrays/specific/hgu133 dot affx; GeneChip Human Genome U133A 2.0 Array at dot affymetrix dot com/products/arrays/specific/hgu133av2 dot affx; and Human Genome U133 Plus 2.0 Array at dot affymetrix dot com/products/arrays/specific/hgu133plus dot affx). The probe names follow the Affymetrix naming convention. The data is available from NCBI Gene Expression Omnibus (see dot ncbi dot nlm dot nih dot gov/projects/geo/and Edgar et al, Nucleic Acids Research, 2002, Vol. 30, No. 1 207-210). The dataset (including results) is available from dot ncbi dot nlm dot nih dot gov/geo/query/acc dot cgi?acc=GSE1133 for the Series GSE1133 database (published on March 2004); a reference to these results is as follows: Su et al (Proc Natl Acad Sci USA. 2004 Apr. 20; 101(16):6062-7. Epub 2004 Apr. 09).

Oligonucleotide probes for use with arrays designed by the present inventors:

```
>S67314_0_0_741
                                          (SEQ ID NO 392)
CACAGAGCCAGGATGTTCTTCTGACCTCAGTATCTACTCCAGCTCCAGCT

>S67314_0_0_744
                                          (SEQ ID NO 393)
TGGCATGCTGGAACATGGACTCTAGCTAGCAAGAAGGGCTCAAGGAGGTG
```

In the heart specific clusters, a first set of abbreviations is used for the first histogram
ADP=adipocyte
BLD=blood
BLDR=bladder
BRN=brain
BONE=bone
BM=bone marrow
BRS=mammary gland
CAR=cartilage
CNS=central nervous system
COL=colon
E-ADR=endocrine_adrenal_gland
E-PAN=endocrine_pancreas
E-PT=endocrine_parathyroid_thyroid
ENDO=endocrine_unchar
EPID=epididymis
GI=gastrointestinal tract
GU=genitourinary
HN=head and neck
HRT=heart
KD=kidney
LI=liver
LUNG=lung
LN=lymph node
MUS=muscle
OV=ovary
PNS=peripheral nervous system
PRO=prostate
SKIN=skin
SPL=spleen
SYN=synovial membrane
TCELL=immune T cells
THYM=thymus
TST=testes
UTER=cervix-uterus
VAS=vascular In the second histogram(s) of the heart paragraph, the oligo-probe names are abbreviated/enumerated as follows:

| | |
|---|---|
| "adipocyte", | "A1"; |
| "adrenalcortex", | "A2"; |
| "adrenalgland", | "A3"; |
| "amygdala", | "A4"; |
| "appendix", | "A5"; |
| "atrioventricularnode", | "A6"; |
| "bm_cd105_endothelial", | "E1"; |
| "bm_cd33_myeloid", | "M1"; |
| "bm_cd34_", | "B1"; |
| "bm_cd71_earlyerythroid", | "E1"; |
| "bonemarrow", | "B2"; |
| "bronchialepithelialcells", | "B3"; |
| "cardiacmyocytes", | "C1"; |
| "caudatenucleus", | "C2"; |
| "cerebellum", | "C3"; |
| "cerebellumpeduncles", | "C4"; |
| "ciliaryganglion", | "C5"; |
| "cingulatecortex", | "C6"; |
| "globuspallidus", | "G1"; |
| "heart", | "H1"; |
| "hypothalamus", | "H2"; |
| "kidney", | "K1"; |
| "liver", | "L1"; |
| "lung", | "L2"; |
| "lymphnode", | "L3"; |
| "medullaoblongata", | "M1"; |
| "occipitallobe", | "O1"; |
| "olfactorybulb", | "O2"; |
| "ovary", | "O3"; |
| "pancreas", | "P1"; |
| "pancreaticislets", | "P2"; |
| "parietallobe", | "P3"; |
| "pb_bdca4_dentritic_cells", | "P4"; |
| "pb_cd14_monocytes", | "P5"; |
| "pb_cd19_bcells", | "P6"; |
| "pb_cd4_tcells", | "P7"; |
| "pb_cd56_nkcells", | "P8"; |
| "pb_cd8_tcells", | "P9"; |
| "pituitary", | "Pa"; |
| "placenta", | "Pb"; |
| "pons", | "Pc"; |
| "prefrontalcortex", | "Pd"; |
| "prostate", | "Pe"; |
| "salivarygland", | "S1"; |
| "skeletalmuscle", | "S2"; |
| "skin", | "S3"; |
| "smoothmuscle", | "S4"; |
| "spinalcord", | "S5"; |
| "subthalamicnucleus", | "S6"; |
| "superiorcervicalganglion", | "S7"; |
| "temporallobe", | "T1"; |
| "testis", | "T2"; |
| "testisgermcell", | "T3"; |
| "testisinterstitial", | "T4"; |
| "testisleydigcell", | "T5"; |
| "testisseminiferoustubule", | "S6"; |
| "thalamus", | "T7"; |
| "thymus", | "T8"; |
| "thyroid", | "T9"; |
| "tonsil", | "Ta"; |
| "trachea", | "Tb"; |
| "trigeminalganglion", | "Tc"; |
| "uterus", | "U1"; |
| "uteruscorpus", | "U2"; |
| "wholeblood", | "W1"; |
| "wholebrain", | "W2"; |

It should be noted that the terms "segment", "seg" and "node" are used interchangeably in reference to nucleic acid sequences of the present invention; they refer to portions of nucleic acid sequences that were shown to have one or more properties as described below. They are also the building blocks that were used to construct complete nucleic acid sequences as described in greater detail below. Optionally and preferably, they are examples of oligonucleotides which are embodiments of the present invention, for example as amplicons, hybridization units and/or from which primers and/or complementary oligonucleotides may optionally be derived, and/or for any other use.

As used herein the phrase "cardiac disease" includes any type of cardiac pathology and/or disorder and/or damage, including both chronic and acute damage, as well as progression from acute to chronic damage of the heart, and also propagation of one acute event to another acute event. An example of the latter may occur when an infarct is followed by another infarct in a relatively short period of time, such as within 24 hours for example. An infarct may also lead to acute heart failure immediately after the infarct, as another example. These non-limiting examples are intended to demonstrate that cardiac disease may also comprise a plurality of acute events.

The term "marker" in the context of the present invention refers to a nucleic acid fragment, a peptide, or a polypeptide, which is differentially present in a sample taken from patients having a cardiac disease, such as acute cardiac damage for example, as compared to a comparable sample taken from subjects who do not have cardiac disease.

As used herein the phrase "differentially present" refers to differences in the quantity of a marker present in a sample taken from patients having cardiac disease as compared to a comparable sample taken from patients who do not have cardiac disease. For example, a nucleic acid fragment may optionally be differentially present between the two samples if the amount of the nucleic acid fragment in one sample is significantly different from the amount of the nucleic acid fragment in the other sample, for example as measured by hybridization and/or NAT-based assays. A polypeptide is differentially present between the two samples if the amount of the polypeptide in one sample is significantly different from the amount of the polypeptide in the other sample. It should be noted that if the marker is detectable in one sample and not detectable in the other, then such a marker can be considered to be differentially present. For example, in the case of acute cardiac damage, it is possible that a marker (such as a protein or fragment thereof) could optionally be present in a blood sample from the patient, indicating the presence of damage; lack of presence of such a marker (and/or presence at a low level) would therefore optionally and preferably indicate a lack of such damage. Alternatively, chronically damaged heart might cause a low level of the marker to be present in the blood sample, while acute damage would cause a high level to be present. One of ordinary skill in the art could easily determine such relative levels of the markers; further guidance is provided in the description of each individual marker below.

As used herein the phrase "diagnostic" means identifying the presence or nature of a pathologic condition. Diagnostic methods differ in their sensitivity and specificity. The "sensitivity" of a diagnostic assay is the percentage of diseased individuals who test positive (percent of "true positives"). Diseased individuals not detected by the assay are "false negatives." Subjects who are not diseased and who test negative in the assay are termed "true negatives." The "specificity" of a diagnostic assay is 1 minus the false positive rate, where the "false positive" rate is defined as the proportion of those without the disease who test positive. While a particular diagnostic method may not provide a definitive diagnosis of a condition, it suffices if the method provides a positive indication that aids in diagnosis.

As used herein the phrase "diagnosing" refers to classifying a disease or a symptom, determining a severity of the disease, monitoring disease progression, forecasting an outcome of a disease and/or prospects of recovery. The term "detecting" may also optionally encompass any of the above.

Diagnosis of a disease according to the present invention can be effected by determining a level of a polynucleotide or a polypeptide of the present invention in a biological sample obtained from the subject, wherein the level determined can be correlated with predisposition to, or presence or absence of the disease. It should be noted that a "biological sample obtained from the subject" may also optionally comprise a sample that has not been physically removed from the subject, as described in greater detail below.

As used herein, the term "level" refers to expression levels of RNA and/or protein or to DNA copy number of a marker of the present invention.

Typically the level of the marker in a biological sample obtained from the subject is different (i.e., increased or decreased) from the level of the same variant in a similar sample obtained from a healthy individual (examples of biological samples are described herein).

Numerous well known tissue or fluid collection methods can be utilized to collect the biological sample from the subject in order to determine the level of DNA, RNA and/or polypeptide of the variant of interest in the subject.

Examples include, but are not limited to, fine needle biopsy, needle biopsy, core needle biopsy and surgical biopsy (e.g., brain biopsy), and lavage. Regardless of the procedure employed, once a biopsy/sample is obtained the level of the variant can be determined and a diagnosis can thus be made.

Determining the level of the same variant in normal tissues of the same origin is preferably effected along-side to detect an elevated expression and/or amplification and/or a decreased expression, of the variant as opposed to the normal tissues.

A "test amount" of a marker refers to an amount of a marker present in a sample being tested. A test amount can be either in absolute amount (e.g., microgram/ml) or a relative amount (e.g., relative intensity of signals).

A "test amount" of a marker refers to an amount of a marker in a subject's sample that is consistent with a diagnosis of cardiac disease. A test amount can be either in absolute amount (e.g., microgram/ml) or a relative amount (e.g., relative intensity of signals).

A "control amount" of a marker can be any amount or a range of amounts to be compared against a test amount of a marker. For example, a control amount of a marker can be the amount of a marker in a patient with cardiac disease or a person without cardiac disease. A control amount can be either in absolute amount (e.g., microgram/ml) or a relative amount (e.g., relative intensity of signals).

"Detect" refers to identifying the presence, absence or amount of the object to be detected.

A "label" includes any moiety or item detectable by spectroscopic, photo chemical, biochemical, immunochemical, or chemical means. For example, useful labels include $^{32}P$, $^{35}S$, fluorescent dyes, electron-dense reagents, enzymes (e.g., as commonly used in an ELISA), biotin-streptavidin, dioxigenin, haptens and proteins for which antisera or monoclonal antibodies are available, or nucleic acid molecules with a sequence complementary to a target. The label often generates a measurable signal, such as a radioactive, chromogenic, or fluorescent signal, that can be used to quantify the amount of bound label in a sample. The label can be incorporated in or attached to a primer or probe either covalently, or through ionic, van der Waals or hydrogen bonds, e.g., incorporation of radioactive nucleotides, or biotinylated nucleotides that are recognized by streptavadin. The label may be directly or indirectly detectable. Indirect detection can involve the binding of a second label to the first label, directly or indirectly. For example, the label can be the ligand of a binding partner, such as biotin, which is a binding partner for streptavadin, or a nucleotide sequence, which is the binding partner for a complementary sequence, to which it can specifically hybridize. The binding partner may itself be directly detectable, for example, an antibody may be itself labeled with a fluorescent molecule. The binding partner also may be indirectly detectable, for example, a nucleic acid having a complementary nucleotide sequence can be a part of a branched DNA molecule that is in turn detectable through hybridization with other labeled nucleic acid molecules (see, e.g., P. D. Fahrlander and A. Klausner, Bio/Technology 6:1165 (1988)). Quantitation of the signal is achieved by, e.g., scintillation counting, densitometry, or flow cytometry.

Exemplary detectable labels, optionally and preferably for use with immunoassays, include but are not limited to magnetic beads, fluorescent dyes, radiolabels, enzymes (e.g., horse radish peroxide, alkaline phosphatase and others commonly used in an ELISA), and calorimetric labels such as colloidal gold or colored glass or plastic beads. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

"Immunoassay" is an assay that uses an antibody to specifically bind an antigen. The immunoassay is characterized by the use of specific binding properties of a particular antibody to isolate, target, and/or quantify the antigen.

The phrase "specifically (or selectively) binds" to an antibody or "specifically (or selectively) immunoreactive with," when referring to a protein or peptide (or other epitope), refers to a binding reaction that is determinative of the presence of the protein in a heterogeneous population of proteins and other biologics. Thus, under designated immunoassay conditions, the specified antibodies bind to a particular protein at least two times greater than the background (non-specific signal) and do not substantially bind in a significant amount to other proteins present in the sample. Specific binding to an antibody under such conditions may require an antibody that is selected for its specificity for a particular protein. For example, polyclonal antibodies raised to seminal basic protein from specific species such as rat, mouse, or human can be selected to obtain only those poyclonal antibodies that are specifically immunoreactive with seminal basic protein and not with other proteins, except for polymorphic variants and alleles of seminal basic protein. This selection may be achieved by subtracting out antibodies that cross-react with seminal basic protein molecules from other species. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, Antibodies, A Laboratory Manual (1988), for a description of immunoassay formats and conditions that can be used to determine specific immunoreactivity). Typically a specific or selective reaction will be at least twice background signal or noise and more typically more than 10 to 100 times background.

According to preferred embodiments of the present invention, there is provided an isolated polynucleotide comprising a transcript selected from the group consisting of SEQ ID NOs: 1, 2, 3 and 4.

According to preferred embodiments of the present invention, there is provided an isolated polynucleotide comprising a segment selected from the group consisting of SEQ ID NOs: 65, 66, 67, 68, 69, 70, 71 and 72.

According to preferred embodiments of the present invention, there is provided an isolated polypeptide comprising a protein variant selected from the group consisting of SEQ ID NOs: 281, 282, 283 and 284.

According to preferred embodiments of the present invention, there is provided an isolated polynucleotide comprising a transcript selected from the group consisting of SEQ ID NOs: 5, 6, 7, 8, 9 and 10

According to preferred embodiments of the present invention, there is provided an isolated polynucleotide comprising a segment selected from the group consisting of SEQ ID NOs: 73, 74, 75, 76, 77, 78, 79, 80, 81, 82, 83, 84, 85, 86, 87, 88, 89, 90, 91, 92, 93 and 94.

According to preferred embodiments of the present invention, there is provided an isolated polypeptide comprising a protein variant selected from the group consisting of SEQ ID NOs: 285, 286, 287, 288, 289, 290 and 291

According to preferred embodiments of the present invention, there is provided an isolated polynucleotide comprising a transcript SELECTED FROM THE GROUP CONSISTING OF SEQ ID NOs: 12, 13, 14, 15, 16 and 17

According to preferred embodiments of the present invention, there is provided an isolated polynucleotide comprising a segment SELECTED FROM THE GROUP CONSISTING OF SEQ ID NOs: 95, 96, 97, 98, 99, 100, 101, 102, 103, 104, 105, 106, 107, 108, 109, 110, 111, 112.

According to preferred embodiments of the present invention, there is provided an isolated polypeptide comprising a protein variant SELECTED FROM THE GROUP CONSISTING OF SEQ ID NOs: 292, 293, 294, 295 and 296

According to preferred embodiments of the present invention, there is provided an isolated polynucleotide comprising a transcript SELECTED FROM THE GROUP CONSISTING OF SEQ ID NOs: 18 and 19.

According to preferred embodiments of the present invention, there is provided an isolated polynucleotide comprising a segment SELECTED FROM THE GROUP CONSISTING OF SEQ ID NOs: 113, 114, 115, 116, 117, 118, 119, 120, 121 and 122.

According to preferred embodiments of the present invention, there is provided an isolated polypeptide comprising a protein variant SELECTED FROM THE GROUP CONSISTING OF SEQ ID NOs: 297 and 298.

According to preferred embodiments of the present invention, there is provided an isolated polynucleotide comprising a transcript SELECTED FROM THE GROUP CONSISTING OF SEQ ID NOs: 20 and 21.

According to preferred embodiments of the present invention, there is provided an isolated polynucleotide comprising a segment SELECTED FROM THE GROUP CONSISTING OF SEQ ID NOs: 123, 124, 125, 126, 127, 128 and 129.

According to preferred embodiments of the present invention, there is provided an isolated polypeptide comprising a protein variant SELECTED FROM THE GROUP CONSISTING OF SEQ ID NOs: 299 and 300.

According to preferred embodiments of the present invention, there is provided an isolated polynucleotide comprising a transcript SELECTED FROM THE GROUP CONSISTING OF SEQ ID NOs: 26, 27, 28, 29 and 30.

According to preferred embodiments of the present invention, there is provided an isolated polynucleotide comprising a segment SELECTED FROM THE GROUP CONSISTING OF SEQ ID NOs: 150, 151, 152, 153, 154, 155, 156, 157, 158, 159, 160, 161, 162 and 163.

According to preferred embodiments of the present invention, there is provided an isolated polypeptide comprising a protein variant SELECTED FROM THE GROUP CONSISTING OF SEQ ID NOs: 305; 306; 307 and 308

According to preferred embodiments of the present invention, there is provided an isolated polynucleotide comprising a transcript SELECTED FROM THE GROUP CONSISTING OF SEQ ID NOs: 31, 32, 33, 34, 35, 36 and 37.

According to preferred embodiments of the present invention, there is provided an isolated polynucleotide comprising a segment SELECTED FROM THE GROUP CONSISTING OF SEQ ID NOs: 164, 165, 166, 167, 168, 169, 170, 171, 172, 173, 174, 175, 176, 177, 178, 179, 180, 181, 182, 183, 184, 185 and 186

According to preferred embodiments of the present invention, there is provided an isolated polypeptide comprising a protein variant SELECTED FROM THE GROUP CONSISTING OF SEQ ID NOs: 309, 310, 311 and 312.

According to preferred embodiments of the present invention, there is provided an isolated polynucleotide comprising a transcript SELECTED FROM THE GROUP CONSISTING OF SEQ ID NOs: 38, 39, 40 and 41.

According to preferred embodiments of the present invention, there is provided an isolated polynucleotide comprising a segment SELECTED FROM THE GROUP CONSISTING OF SEQ ID NOs: 187, 188, 189, 190, 191, 192, 193, 194, 195 and 196.

According to preferred embodiments of the present invention, there is provided an isolated polypeptide comprising a protein variant SELECTED FROM THE GROUP CONSISTING OF SEQ ID NOs: 313, 314, 315 and 316.

According to preferred embodiments of the present invention, there is provided an isolated polynucleotide comprising a transcript SELECTED FROM THE GROUP CONSISTING OF SEQ ID NOs: 42, 43, 44, 45, 46, 47, 48, 49 and 50.

According to preferred embodiments of the present invention, there is provided an isolated polynucleotide comprising a segment SELECTED FROM THE GROUP CONSISTING OF SEQ ID NOs: 197, 198, 199, 200, 201, 202, 203, 204, 205, 206, 207 and 208.

According to preferred embodiments of the present invention, there is provided an isolated polypeptide comprising a protein variant SELECTED FROM THE GROUP CONSISTING OF SEQ ID NOs: 317, 318, 319, 320, 321, 322, 323, 324 and 325.

According to preferred embodiments of the present invention, there is provided an isolated polynucleotide comprising a transcript SELECTED FROM THE GROUP CONSISTING OF SEQ ID NOs:51, 52, 53, 54, 55, 56, 57, 58, 59 and 60.

According to preferred embodiments of the present invention, there is provided an isolated polynucleotide comprising a segment SELECTED FROM THE GROUP CONSISTING OF SEQ ID NOs: 209 to 273.

According to preferred embodiments of the present invention, there is provided an isolated polypeptide comprising a protein variant selected from the group consisting of SEQ ID NOs: 326 to 334.

According to preferred embodiments of the present invention, there is provided an isolated polynucleotide comprising a transcript selected from the group consisting of SEQ ID NOs: 22-25, 353 or 386.

According to preferred embodiments of the present invention, there is provided an isolated polynucleotide comprising a segment selected from the group consisting of SEQ ID NOs: 130-149.

According to preferred embodiments of the present invention, there is provided an isolated polypeptide comprising a protein variant selected from the group consisting of SEQ ID NOs: 301-304, 325, 354-356 or 387.

According to preferred embodiments of the present invention, there is provided an isolated chimeric polypeptide encoding for SEQ ID NO. 326, comprising a first amino acid sequence being at least 90% homologous to amino acids 1-1855 of SEQ ID NO.338, which also corresponds to amino acids 1-1855 of SEQ ID NO.326, and a second amino acid sequence being at least 70%, optionally at least 80%, preferably at least 85%, more preferably at least 90% and most preferably at least 95% homologous to a polypeptide sequence corresponding to amino acids 1856-1904 of SEQ ID NO. 326, wherein said first amino acid sequence and second amino acid sequence are contiguous and in a sequential order.

According to preferred embodiments of the present invention, there is provided an isolated polypeptide encoding for a tail of SEQ ID NO. 326, comprising a polypeptide being at least 70%, optionally at least about 80%, preferably at least about 85%, more preferably at least about 90% and most preferably at least about 95% homologous to the sequence VRRTPDTGSRCGSFFS-GPTAPPSQGSSHLLLEMLLVDLTFFSRSAVSLT (SEQ ID NO:394) in SEQ ID NO. 326.

According to preferred embodiments of the present invention, there is provided an isolated chimeric polypeptide encoding for SEQ ID NO. 327, comprising a first amino acid sequence being at least 90% homologous to amino acids 1-1326 of SEQ ID NO. 339, which also corresponds to amino acids 1-1326 of SEQ ID NO. 327, and a second amino acid sequence being at least 70%, optionally at least 80%, preferably at least 85%, more preferably at least 90% and most preferably at least 95% homologous to a polypeptide sequence corresponding to amino acids 1327-1336 of SEQ ID NO. 327, wherein said first amino acid sequence and second amino acid sequence are contiguous and in a sequential order.

According to preferred embodiments of the present invention, there is provided an isolated polypeptide encoding for a tail of SEQ ID NO. 327, comprising a polypeptide being at least 70%, optionally at least about 80%, preferably at least about 85%, more preferably at least about 90% and most preferably at least about 95% homologous to the sequence VRPSGEGGQA (SEQ ID NO:431) in SEQ ID NO. 327.

According to preferred embodiments of the present invention, there is provided an isolated chimeric polypeptide encoding for SEQ ID NO. 328, comprising a first amino acid sequence being at least 90% homologous to corresponding to amino acids 1-1508 of SEQ ID NO. 339, which also corresponds to amino acids 1-1508 of SEQ ID NO. 328, and a second amino acid sequence being at least 70%, optionally at least 80%, preferably at least 85%, more preferably at least 90% and most preferably at least 95% homologous to a polypeptide sequence corresponding to amino acids 1509-1534 of SEQ ID NO. 328, wherein said first amino acid sequence and second amino acid sequence are contiguous and in a sequential order.

According to preferred embodiments of the present invention, there is provided an isolated polypeptide encoding for a tail of SEQ ID NO. 328, comprising a polypeptide being at least 70%, optionally at least about 80%, preferably at least about 85%, more preferably at least about 90% and most preferably at least about 95% homologous to the sequence GVLGVQEARDELVGGRAMQGQGEHRL (SEQ ID NO:432) in SEQ ID NO. 328.

According to preferred embodiments of the present invention, there is provided an isolated chimeric polypeptide encoding for SEQ ID NO. 329, comprising a first amino acid sequence being at least 90% homologous to corresponding to amino acids 1-1763 of SEQ ID NO. 338, which also corresponds to amino acids 1-1763 of SEQ ID NO. 329, and a second amino acid sequence being at least 70%, optionally at least 80%, preferably at least 85%, more preferably at least 90% and most preferably at least 95% homologous to a polypeptide sequence corresponding to amino acids 1764-1788 of SEQ ID NO. 329, wherein said first amino acid sequence and second amino acid sequence are contiguous and in a sequential order.

According to preferred embodiments of the present invention, there is provided an isolated polypeptide encoding for a tail of SEQ ID NO. 329, comprising a polypeptide being at least 70%, optionally at least about 80%, preferably at least about 85%, more preferably at least about 90% and most preferably at least about 95% homologous to the sequence VSDRPPSASPKDRNKALGPGQATVL (SEQ ID NO:432) in SEQ ID NO. 329.

According to preferred embodiments of the present invention, there is provided an isolated chimeric polypeptide encoding for SEQ ID NO. 330, comprising a first amino acid sequence being at least 70%, optionally at least 80%, preferably at least 85%, more preferably at least 90% and most preferably at least 95% homologous to a polypeptide sequence corresponding to amino acids 1-22 of SEQ ID NO. 330, and a second amino acid sequence being at least 90% homologous to amino acids 528-1939 of SEQ ID NO. 340, which also corresponds to amino acids 23-1434 of SEQ ID NO. 330, wherein said first amino acid sequence and second amino acid sequence are contiguous and in a sequential order.

According to preferred embodiments of the present invention, there is provided an isolated polypeptide encoding for a head of SEQ ID NO. 330, comprising a polypeptide being at least 70%, optionally at least about 80%, preferably at least about 85%, more preferably at least about 90% and most preferably at least about 95% homologous to the sequence MGLWKPGSVLSDSLFASSPCPQ (SEQ ID NO:395) of SEQ ID NO. 330.

According to preferred embodiments of the present invention, there is provided an isolated chimeric polypeptide encoding for SEQ ID NO. 331, comprising a first amino acid sequence being at least 90% homologous to amino acids 1-527 of SEQ ID NO. 339, which also corresponds to amino acids 1-527 of SEQ ID NO. 331, and a second amino acid sequence being at least 70%, optionally at least 80%, preferably at least 85%, more preferably at least 90% and most preferably at least 95% homologous to a polypeptide sequence corresponding to amino acids 528-555 of SEQ ID NO. 331, wherein said first amino acid sequence and second amino acid sequence are contiguous and in a sequential order.

According to preferred embodiments of the present invention, there is provided an isolated polypeptide encoding for a tail of SEQ ID NO. 331, comprising a polypeptide being at least 70%, optionally at least about 80%, preferably at least about 85%, more preferably at least about 90% and most preferably at least about 95% homologous to the sequence VPPWPHHLCPLLCHPDKVVAESLLHPRN (SEQ ID NO:435) in SEQ ID NO. 331.

According to preferred embodiments of the present invention, there is provided an isolated chimeric polypeptide encoding for SEQ ID NO.332, comprising a first amino acid sequence being at least 90% homologous to corresponding to amino acids 1-470 of SEQ ID NO.338, which also corresponds to amino acids 1-470 of SEQ ID NO.332, a second amino acid sequence being at least 90% homologous to amino acids 528-1855 of SEQ ID NO.338, which also corresponds to amino acids 471-1798 of SEQ ID NO.332, and a third amino acid sequence being at least 70%, optionally at least 80%, preferably at least 85%, more preferably at least 90% and most preferably at least 95% homologous to a polypeptide sequence corresponding to amino acids 1799-1847 of SEQ ID NO.332, wherein said first amino acid sequence, second amino acid sequence and third amino acid sequence are contiguous and in a sequential order.

According to preferred embodiments of the present invention, there is provided an isolated chimeric polypeptide encoding for an edge portion of SEQ ID NO.332, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DP, having a structure as follows: a sequence starting from any of amino acid numbers 470–x to 470; and ending at any of amino acid numbers 471+((n−2)−x), in which x varies from 0 to n−2.

According to preferred embodiments of the present invention, there is provided an isolated polypeptide encoding for a tail of SEQ ID NO. 332, comprising a polypeptide being at least 70%, optionally at least about 80%, preferably at least about 85%, more preferably at least about 90% and most preferably at least about 95% homologous to the sequence VRRTPDTGSRCGSFFS-GPTAPPSQGSSHLLLEMLLVDLTFFSRSAVSLT (SEQ ID NO:394) in SEQ ID NO.332.

According to preferred embodiments of the present invention, there is provided an isolated chimeric polypeptide encoding for SEQ ID NO.333, comprising a first amino acid sequence being at least 90% homologous to amino acids 165-1939 of SEQ ID NO. 340, which also corresponds to amino acids 1-1775 of SEQ ID NO.333.

According to preferred embodiments of the present invention, there is provided an isolated chimeric polypeptide encoding for SEQ ID NO.334, comprising a first amino acid sequence being at least 90% homologous to corresponding to amino acids 1165-1939 of SEQ ID NO. 340, which also corresponds to amino acids 1-775 of SEQ ID NO.334.

According to preferred embodiments of the present invention, there is provided an isolated chimeric polypeptide encoding for SEQ ID NO.317, comprising a first amino acid sequence being at least 90% homologous to amino acids 1-158 of SEQ ID NO. 341, which also corresponds to amino acids 1-158 of SEQ ID NO.317.

According to preferred embodiments of the present invention, there is provided an isolated chimeric polypeptide encoding for SEQ ID NO.318, comprising a first amino acid sequence being at least 90% homologous to amino acids 1-156 of SEQ ID NO. 341, which also corresponds to amino acids 1-156 of SEQ ID NO.318, and a second amino acid sequence being at least 70%, optionally at least 80%, preferably at least 85%, more preferably at least 90% and most preferably at least 95% homologous to a polypeptide sequence corresponding to amino acids 157-166 of SEQ ID NO.318, wherein said first amino acid sequence and second amino acid sequence are contiguous and in a sequential order.

According to preferred embodiments of the present invention, there is provided an isolated polypeptide encoding for a tail of SEQ ID NO.318, comprising a polypeptide being at least 70%, optionally at least about 80%, preferably at least about 85%, more preferably at least about 90% and most preferably at least about 95% homologous to the sequence VSVGQECGSG (SEQ ID NO:423) in SEQ ID NO.318.

According to preferred embodiments of the present invention, there is provided an isolated chimeric polypeptide encoding for SEQ ID NO.319, comprising a first amino acid sequence being at least 90% homologous to amino acids 1-156 of SEQ ID NO. 341, which also corresponds to amino acids 1-156 of SEQ ID NO.319, and a second amino acid sequence being at least 70%, optionally at least 80%, preferably at least 85%, more preferably at least 90% and most preferably at least 95% homologous to a polypeptide sequence corresponding to amino acids 157-210 of SEQ ID NO.319, wherein said first amino acid sequence and second amino acid sequence are contiguous and in a sequential order.

According to preferred embodiments of the present invention, there is provided an isolated polypeptide encoding for a tail of SEQ ID NO.319, comprising a polypeptide being at least 70%, optionally at least about 80%, preferably at least about 85%, more preferably at least about 90% and most preferably at least about 95% homologous to the sequence DGISSLCYSSLSKSLLSQPLRETSSAIN-DISLLQALMPLLGWTSHWTCITVGLY (SEQ ID NO:424) in SEQ ID NO.319.

According to preferred embodiments of the present invention, there is provided an isolated chimeric polypeptide encoding for SEQ ID NO. 320, comprising a first amino acid sequence being at least 90% homologous to amino acids 1-60 of Q96NR4 (SEQ ID NO:342), which also corresponds to amino acids 1-60 of SEQ ID NO. 320, and a second amino acid sequence being at least 70%, optionally at least 80%, preferably at least 85%, more preferably at least 90% and most preferably at least 95% homologous to a polypeptide sequence corresponding to amino acids 61-114 of SEQ ID NO. 320, wherein said first amino acid sequence and second amino acid sequence are contiguous and in a sequential order.

According to preferred embodiments of the present invention, there is provided an isolated polypeptide encoding for a tail of SEQ ID NO. 320, comprising a polypeptide being at least 70%, optionally at least about 80%, preferably at least about 85%, more preferably at least about 90% and most preferably at least about 95% homologous to the sequence DGISSLCYSSLSKSLLSQPLRETSSAIN-DISLLQALMPLLGWTSHWTCITVGLY (SEQ ID NO:424) in SEQ ID NO. 320.

According to preferred embodiments of the present invention, there is provided an isolated chimeric polypeptide encoding for SEQ ID NO. 320, comprising a first amino acid sequence being at least 90% homologous to amino acids 97-156 of SEQ ID NO. 341, which also corresponds to amino acids 1-60 of SEQ ID NO. 320, and a second amino acid sequence being at least 70%, optionally at least 80%, preferably at least 85%, more preferably at least 90% and most preferably at least 95% homologous to a polypeptide sequence corresponding to amino acids 61-114 of SEQ ID NO. 320, wherein said first amino acid sequence and second amino acid sequence are contiguous and in a sequential order.

According to preferred embodiments of the present invention, there is provided an isolated chimeric polypeptide encoding for SEQ ID NO. 321, comprising a first amino acid sequence being at least 90% homologous to amino acids 1-14 of SEQ ID NO. 342, which also corresponds to amino acids 1-14 of SEQ ID NO. 321, a second amino acid sequence bridging amino acid sequence comprising of S, and a third amino acid sequence being at least 90% homologous to corresponding to amino acids 62-133 of SEQ ID NO. 342, which also corresponds to amino acids 16-87 of SEQ ID NO. 321, wherein said first amino acid sequence, second amino acid sequence and third amino acid sequence are contiguous and in a sequential order.

According to preferred embodiments of the present invention, there is provided an isolated polypeptide encoding for an edge portion of SEQ ID NO. 321, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least three amino acids comprise VSI having a structure as follows (numbering according to SEQ ID NO. 321): a sequence starting from any of amino acid numbers 14−x to 14; and ending at any of amino acid numbers 16+((n−2)−x), in which x varies from 0 to n−2.

According to preferred embodiments of the present invention, there is provided an isolated chimeric polypeptide encoding for SEQ ID NO. 321, comprising a first amino acid sequence being at least 70%, optionally at least 80%, preferably at least 85%, more preferably at least 90% and most preferably at least 95% homologous to a polypeptide sequence corresponding to amino acids 1-15 of SEQ ID NO. 321, and a second amino acid sequence being at least 90% homologous to corresponding to amino acids 39-110 of SEQ ID NO. 343, which also corresponds to amino acids 16-87 of SEQ ID NO. 321, wherein said first amino acid sequence and second amino acid sequence are contiguous and in a sequential order.

According to preferred embodiments of the present invention, there is provided an isolated polypeptide encoding for a head of SEQ ID NO. 321, comprising a polypeptide being at least 70%, optionally at least about 80%, preferably at least about 85%, more preferably at least about 90% and most preferably at least about 95% homologous to the sequence MRGEHNSTSYDSAVS (SEQ ID NO:426) of SEQ ID NO. 321.

According to preferred embodiments of the present invention, there is provided an isolated chimeric polypeptide encoding for SEQ ID NO. 321, comprising a first amino acid sequence being at least 90% homologous to corresponding to amino acids 97-110 of SEQ ID NO. 341, which also corresponds to amino acids 1-14 of SEQ ID NO. 321, a second amino acid sequence bridging amino acid sequence comprising of S, and a third amino acid sequence being at least 90% homologous to corresponding to amino acids 158-229 of SEQ ID NO. 341, which also corresponds to amino acids 16-87 of SEQ ID NO. 321, wherein said first amino acid sequence, second amino acid sequence and third amino acid sequence are contiguous and in a sequential order.

According to preferred embodiments of the present invention, there is provided an isolated polypeptide encoding for an edge portion of SEQ ID NO. 321, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least three amino acids comprise VSI having a structure as follows (numbering according to SEQ ID NO. 321): a sequence starting from any of amino acid numbers 14−x to 14; and ending at any of amino acid numbers 16+((n−2)−x), in which x varies from 0 to n−2.

According to preferred embodiments of the present invention, there is provided an isolated polypeptide encoding for a tail of SEQ ID NO. 320, comprising a polypeptide being at least 70%, optionally at least about 80%, preferably at least about 85%, more preferably at least about 90% and most preferably at least about 95% homologous to the sequence DGISSLCYSSLSKSLLSQPLRETSSAIN-DISLLQALMPLLGWTSHWTCITVGLY (SEQ ID NO:424) in SEQ ID NO. 320.

According to preferred embodiments of the present invention, there is provided an isolated chimeric polypeptide encoding for SEQ ID NO. 321, comprising a first amino acid sequence being at least 90% homologous to corresponding to amino acids 1-14 of SEQ ID NO. 342, which also corresponds to amino acids 1-14 of SEQ ID NO. 321, a second amino acid sequence bridging amino acid sequence comprising of S, and a third amino acid sequence being at least 90% homologous to corresponding to amino acids 62-133 of SEQ ID NO. 342, which also corresponds to amino acids 16-87 of SEQ ID NO. 321, wherein said first amino acid sequence, second amino acid sequence and third amino acid sequence are contiguous and in a sequential order.

According to preferred embodiments of the present invention, there is provided an isolated polypeptide encoding for an edge portion of SEQ ID NO. 321, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least three amino acids comprise VSI having a structure as follows (numbering according to SEQ ID NO. 321): a sequence starting from any of amino acid numbers 14−x to 14; and ending at any of amino acid numbers 16+((n−2)−x), in which x varies from 0 to n−2.

According to preferred embodiments of the present invention, there is provided an isolated chimeric polypeptide encoding for SEQ ID NO. 321, comprising a first amino acid sequence being at least 70%, optionally at least 80%, preferably at least 85%, more preferably at least 90% and most preferably at least 95% homologous to a polypeptide sequence corresponding to amino acids 1-15 of SEQ ID NO. 321, and a second amino acid sequence being at least 90% homologous to corresponding to amino acids 39-110 of SEQ ID NO. 343, which also corresponds to amino acids 16-87 of SEQ ID NO. 321, wherein said first amino acid sequence and second amino acid sequence are contiguous and in a sequential order.

According to preferred embodiments of the present invention, there is provided an isolated polypeptide encoding for a head of SEQ ID NO. 321, comprising a polypeptide being at least 70%, optionally at least about 80%, preferably at least about 85%, more preferably at least about 90% and most preferably at least about 95% homologous to the sequence MRGEHNSTSYDSAVS (SEQ ID NO:426) of SEQ ID NO. 321.

According to preferred embodiments of the present invention, there is provided an isolated chimeric polypeptide encoding for SEQ ID NO. 321, comprising a first amino acid sequence being at least 90% homologous to corresponding to amino acids 97-110 of SEQ ID NO. 341, which also corresponds to amino acids 1-14 of SEQ ID NO. 321, a second amino acid sequence bridging amino acid sequence comprising of S, and a third amino acid sequence being at least 90% homologous to corresponding to amino acids 158-229 of SEQ ID NO. 341, which also corresponds to amino acids 16-87 of SEQ ID NO. 321, wherein said first amino acid sequence, second amino acid sequence and third amino acid sequence are contiguous and in a sequential order.

According to preferred embodiments of the present invention, there is provided an isolated polypeptide encoding for an edge portion of SEQ ID NO. 321, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least three amino acids comprise VSI having a structure as follows (numbering according to SEQ ID NO. 321): a sequence starting from any of amino acid numbers 14−x to 14; and ending at any of amino acid numbers 16+((n−2)−x), in which x varies from 0 to n−2.

According to preferred embodiments of the present invention, there is provided an isolated chimeric polypeptide encoding for SEQ ID NO. 322, comprising a first amino acid sequence being at least 90% homologous to corresponding to amino acids 1-62 of SEQ ID NO. 342, which also corresponds to amino acids 1-62 of SEQ ID NO. 322.

According to preferred embodiments of the present invention, there is provided an isolated chimeric polypeptide encoding for SEQ ID NO. 322, comprising a first amino acid sequence being at least 70%, optionally at least 80%, preferably at least 85%, more preferably at least 90% and most preferably at least 95% homologous to a polypeptide sequence corresponding to amino acids 1-23 of SEQ ID NO. 322, and a second amino acid sequence being at least 90% homologous to corresponding to amino acids 1-39 of SEQ ID NO. 343, which also corresponds to amino acids 24-62 of SEQ ID NO. 322, wherein said first amino acid sequence and second amino acid sequence are contiguous and in a sequential order.

According to preferred embodiments of the present invention, there is provided an isolated polypeptide encoding for a head of SEQ ID NO. 322, comprising a polypeptide being at least 70%, optionally at least about 80%, preferably at least about 85%, more preferably at least about 90% and most preferably at least about 95% homologous to the sequence MRGEHNSTSYDSAVIYRGFWAVL (SEQ ID NO:427) of SEQ ID NO. 322.

According to preferred embodiments of the present invention, there is provided an isolated chimeric polypeptide encoding for SEQ ID NO. 322, comprising a first amino acid sequence being at least 90% homologous to corresponding to amino acids 97-158 of SEQ ID NO. 341, which also corresponds to amino acids 1-62 of SEQ ID NO. 322.

According to preferred embodiments of the present invention, there is provided an isolated chimeric polypeptide encoding for SEQ ID NO. 324, comprising a first amino acid sequence being at least 90% homologous to corresponding to amino acids 1-60 of SEQ ID NO. 342, which also corresponds to amino acids 1-60 of SEQ ID NO. 324, and a second amino acid sequence being at least 70%, optionally at least 80%, preferably at least 85%, more preferably at least 90% and most preferably at least 95% homologous to a polypeptide sequence corresponding to amino acids 61-70 of SEQ ID NO. 324, wherein said first amino acid sequence and second amino acid sequence are contiguous and in a sequential order.

According to preferred embodiments of the present invention, there is provided an isolated polypeptide encoding for a tail of SEQ ID NO. 324, comprising a polypeptide being at least 70%, optionally at least about 80%, preferably at least about 85%, more preferably at least about 90% and most preferably at least about 95% homologous to the sequence VSVGQECGSG (SEQ ID NO:423) in SEQ ID NO. 324.

According to preferred embodiments of the present invention, there is provided an isolated chimeric polypeptide encoding for SEQ ID NO. 324, comprising a first amino acid sequence being at least 70%, optionally at least 80%, preferably at least 85%, more preferably at least 90% and most preferably at least 95% homologous to a polypeptide sequence corresponding to amino acids 1-23 of SEQ ID NO. 324, a second amino acid sequence being at least 90% homologous to corresponding to amino acids 1-37 of SEQ ID NO. 343, which also corresponds to amino acids 24-60 of SEQ ID NO. 324, and a third amino acid sequence being at least 70%, optionally at least 80%, preferably at least 85%, more preferably at least 90% and most preferably at least 95% homologous to a polypeptide having the sequence corresponding to amino acids 61-70 of SEQ ID NO. 324, wherein said first amino acid sequence, second amino acid sequence and third amino acid sequence are contiguous and in a sequential order.

According to preferred embodiments of the present invention, there is provided an isolated polypeptide encoding for a head of SEQ ID NO. 324, comprising a polypeptide being at least 70%, optionally at least about 80%, preferably at least about 85%, more preferably at least about 90% and most preferably at least about 95% homologous to the sequence MRGEHNSTSYDSAVIYRGFWAVL (SEQ ID NO:427) of SEQ ID NO. 324.

According to preferred embodiments of the present invention, there is provided an isolated polypeptide encoding for a tail of SEQ ID NO. 324, comprising a polypeptide being at least 70%, optionally at least about 80%, preferably at least about 85%, more preferably at least about 90% and most preferably at least about 95% homologous to the sequence VSVGQECGSG (SEQ ID NO:423) in SEQ ID NO. 324.

According to preferred embodiments of the present invention, there is provided an isolated chimeric polypeptide encoding for SEQ ID NO. 324, comprising a first amino acid sequence being at least 90% homologous to corresponding to amino acids 97-156 of SEQ ID NO. 341, which also corresponds to amino acids 1-60 of SEQ ID NO. 324, and a second amino acid sequence being at least 70%, optionally at least 80%, preferably at least 85%, more preferably at least 90% and most preferably at least 95% homologous to a polypeptide having the sequence corresponding to amino acids 61-70 of SEQ ID NO. 324, wherein said first amino acid sequence and second amino acid sequence are contiguous and in a sequential order.

According to preferred embodiments of the present invention, there is provided an isolated polypeptide encoding for a tail of SEQ ID NO. 324, comprising a polypeptide being at least 70%, optionally at least about 80%, preferably at least about 85%, more preferably at least about 90% and most preferably at least about 95% homologous to the sequence VSVGQECGSG (SEQ ID NO:423) in SEQ ID NO. 324.

According to preferred embodiments of the present invention, there is provided an isolated chimeric polypeptide encoding for SEQ ID NO. 313, comprising a first amino acid sequence being at least 90% homologous to corresponding to amino acids 1-115 of SEQ ID NO. 344, which also corresponds to amino acids 1-115 of SEQ ID NO. 313, and a second amino acid sequence being at least 90% homologous to corresponding to amino acids 152-319 of SEQ ID NO. 344, which also corresponds to amino acids 116-283 of SEQ ID NO. 313, wherein said first amino acid sequence and second amino acid sequence are contiguous and in a sequential order.

According to preferred embodiments of the present invention, there is provided an isolated chimeric polypeptide encoding for an edge portion of SEQ ID NO. 313, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IY, having a structure as follows: a sequence starting from any of amino acid numbers 115–x to 115; and ending at any of amino acid numbers 116+((n–2)–x), in which x varies from 0 to n–2.

According to preferred embodiments of the present invention, there is provided an isolated chimeric polypeptide encoding for SEQ ID NO. 313, of cluster Z36249 comprising a first amino acid sequence being at least 90% homologous to corresponding to amino acids 1-70 of SEQ ID NO. 345, which also corresponds to amino acids 1-70 of SEQ ID NO. 313, a bridging amino acid K corresponding to amino acid 71 of SEQ ID NO. 313, a second amino acid sequence being at least 90% homologous to corresponding to amino acids 72-115 of SEQ ID NO. 345, which also corresponds to amino acids 72-115 of SEQ ID NO. 313, and a third amino acid sequence being at least 90% homologous to corresponding to amino acids 152-319 of SEQ ID NO. 345, which also corresponds to amino acids 116-283 of SEQ ID NO. 313, wherein said first amino acid sequence, bridging amino acid, second amino acid sequence and third amino acid sequence are contiguous and in a sequential order.

According to preferred embodiments of the present invention, there is provided an isolated chimeric polypeptide encoding for SEQ ID NO. 314, comprising a first amino acid sequence being at least 90% homologous to corresponding to amino acids 1-184 of SEQ ID NO. 344, which also corresponds to amino acids 1-184 of SEQ ID NO. 314, and a second amino acid sequence being at least 70%, optionally at least 80%, preferably at least 85%, more preferably at least 90% and most preferably at least 95% homologous to a polypeptide sequence corresponding to amino acids 185-197 of SEQ ID NO. 314, wherein said first amino acid sequence and second amino acid sequence are contiguous and in a sequential order.

According to preferred embodiments of the present invention, there is provided an isolated polypeptide encoding for a tail of SEQ ID NO. 314, comprising a polypeptide being at least 70%, optionally at least about 80%, preferably at least about 85%, more preferably at least about 90% and most preferably at least about 95% homologous to the sequence VNIFLCLGMSQKK (SEQ ID NO:421) in SEQ ID NO. 314.

According to preferred embodiments of the present invention, there is provided an isolated chimeric polypeptide encoding for SEQ ID NO. 314, comprising a first amino acid sequence being at least 90% homologous to corresponding to amino acids 1-70 of SEQ ID NO. 345, which also corresponds to amino acids 1-70 of SEQ ID NO. 314, a bridging amino acid K corresponding to amino acid 71 of SEQ ID NO. 314, a second amino acid sequence being at least 90% homologous to corresponding to amino acids 72-184 of SEQ ID NO. 345, which also corresponds to amino acids 72-184 of SEQ ID NO. 314, and a third amino acid sequence being at least 70%, optionally at least 80%, preferably at least 85%, more preferably at least 90% and most preferably at least 95% homologous to a polypeptide having the sequence corresponding to amino acids 185-197 of SEQ ID NO. 314, wherein said first amino acid sequence, bridging amino acid, second amino acid sequence and third amino acid sequence are contiguous and in a sequential order.

According to preferred embodiments of the present invention, there is provided an isolated polypeptide encoding for a tail of SEQ ID NO. 314, comprising a polypeptide being at least 70%, optionally at least about 80%, preferably at least about 85%, more preferably at least about 90% and most preferably at least about 95% homologous to the sequence VNIFLCLGMSQKK (SEQ ID NO:421) in SEQ ID NO. 314.

According to preferred embodiments of the present invention, there is provided an isolated chimeric polypeptide encoding for an edge portion of SEQ ID NO. 313, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IY, having a structure as follows: a sequence starting from any of amino acid numbers 115−x to 115; and ending at any of amino acid numbers 116+((n−2)−x), in which x varies from 0 to n−2.

According to preferred embodiments of the present invention, there is provided an isolated chimeric polypeptide encoding for SEQ ID NO. 315, comprising a first amino acid sequence being at least 90% homologous to corresponding to amino acids 1-151 of SEQ ID NO. 344, which also corresponds to amino acids 1-151 of SEQ ID NO. 315, and a second amino acid sequence being at least 70%, optionally at least 80%, preferably at least 85%, more preferably at least 90% and most preferably at least 95% homologous to a polypeptide sequence corresponding to amino acids 152-177 of SEQ ID NO. 315, wherein said first amino acid sequence and second amino acid sequence are contiguous and in a sequential order.

According to preferred embodiments of the present invention, there is provided an isolated polypeptide encoding for a tail of SEQ ID NO. 315, comprising a polypeptide being at least 70%, optionally at least about 80%, preferably at least about 85%, more preferably at least about 90% and most preferably at least about 95% homologous to the sequence VRLMQSTAKSSSLILCFLCFTPVLLI (SEQ ID NO:422) in SEQ ID NO. 315.

According to preferred embodiments of the present invention, there is provided an isolated chimeric polypeptide encoding for SEQ ID NO. 315, comprising a first amino acid sequence being at least 90% homologous to amino acids 1-70 of SEQ ID NO. 345, which also corresponds to amino acids 1-70 of SEQ ID NO. 315, a bridging amino acid K corresponding to amino acid 71 of SEQ ID NO. 315, a second amino acid sequence being at least 90% homologous to amino acids 72-151 of SEQ ID NO. 345, which also corresponds to amino acids 72-151 of SEQ ID NO. 315, and a third amino acid sequence being at least 70%, optionally at least 80%, preferably at least 85%, more preferably at least 90% and most preferably at least 95% homologous to a polypeptide sequence corresponding to amino acids 152-177 of SEQ ID NO. 315, wherein said first amino acid sequence, bridging amino acid, second amino acid sequence and third amino acid sequence are contiguous and in a sequential order.

According to preferred embodiments of the present invention, there is provided an isolated polypeptide encoding for a tail of SEQ ID NO. 315, comprising a polypeptide being at least 70%, optionally at least about 80%, preferably at least about 85%, more preferably at least about 90% and most preferably at least about 95% homologous to the sequence VRLMQSTAKSSSLILCFLCFTPVLLI (SEQ ID NO:422) in SEQ ID NO. 315.

According to preferred embodiments of the present invention, there is provided an isolated chimeric polypeptide encoding for SEQ ID NO. 316, comprising a first amino acid sequence being at least 90% homologous to amino acids 1-151 of SEQ ID NO. 344, which also corresponds to amino acids 1-151 of SEQ ID NO. 316, and a second amino acid sequence being at least 90% homologous to amino acids 185-319 of SEQ ID NO. 344, which also corresponds to amino acids 152-286 of SEQ ID NO. 316, wherein said first amino acid sequence and second amino acid sequence are contiguous and in a sequential order.

According to preferred embodiments of the present invention, there is provided an isolated chimeric polypeptide encoding for an edge portion of SEQ ID NO. 316, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EL, having a structure as follows: a sequence starting from any of amino acid numbers 151−x to 151; and ending at any of amino acid numbers 152+((n−2)−x), in which x varies from 0 to n−2.

According to preferred embodiments of the present invention, there is provided an isolated chimeric polypeptide encoding for SEQ ID NO. 316, comprising a first amino acid sequence being at least 90% homologous to amino acids 1-70 of SEQ ID NO. 345, which also corresponds to amino acids 1-70 of SEQ ID NO. 316, a bridging amino acid K corresponding to amino acid 71 of SEQ ID NO. 316, a second amino acid sequence being at least 90% homologous to amino acids 72-151 of SEQ ID NO. 345, which also corresponds to amino acids 72-151 of SEQ ID NO. 316, and a third amino acid sequence being at least 90% homologous to amino acids 185-319 of SEQ ID NO. 345, which also corresponds to amino acids 152-286 of SEQ ID NO. 316, wherein said first amino acid sequence, bridging amino acid, second amino acid sequence and third amino acid sequence are contiguous and in a sequential order.

According to preferred embodiments of the present invention, there is provided an isolated chimeric polypeptide encoding for an edge portion of SEQ ID NO. 316, of cluster Z36249 comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EL, having a structure as follows: a sequence starting from any of amino acid numbers 151−x to 151; and ending at any of amino acid numbers 152+((n−2)−x), in which x varies from 0 to n−2.

According to preferred embodiments of the present invention, there is provided an isolated chimeric polypeptide encoding for SEQ ID NO. 309, comprising a first amino acid sequence being at least 90% homologous to amino acids 1-42 of SEQ ID NO. 346, which also corresponds to amino acids 1-42 of SEQ ID NO. 309, a bridging amino acid N corresponding to amino acid 43 of SEQ ID NO. 309, a second amino acid sequence being at least 90% homologous to amino acids 44-657 of SEQ ID NO. 346, which also corresponds to amino acids 44-657 of SEQ ID NO. 309, and a third amino acid sequence being at least 70%, optionally at least 80%, preferably at least 85%, more preferably at least 90% and most preferably at least 95% homologous to a polypeptide sequence corresponding to amino acids 658-708 of SEQ ID NO. 309, wherein said first amino acid sequence, bridging amino acid, second amino acid sequence and third amino acid sequence are contiguous and in a sequential order.

According to preferred embodiments of the present invention, there is provided an isolated polypeptide encoding for a tail of SEQ ID NO. 309, comprising a polypeptide being at least 70%, optionally at least about 80%, preferably at least about 85%, more preferably at least about 90% and most preferably at least about 95% homologous to the sequence VRPHLTLKAPLGLRMHRDPLRTPSPKSW-PLTQPLTPDATLTPQAILTPTLT (SEQ ID NO:418) in SEQ ID NO. 309.

According to preferred embodiments of the present invention, there is provided an isolated chimeric polypeptide encoding for SEQ ID NO. 310, comprising a first amino acid sequence being at least 90% homologous to amino acids 1-42 of SEQ ID NO. 346, which also corresponds to amino acids 1-42 of SEQ ID NO. 310, a bridging amino acid N corresponding to amino acid 43 of SEQ ID NO. 310, a second amino acid sequence being at least 90% homologous to amino acids 44-676 of SEQ ID NO. 346, which also corresponds to amino acids 44-676 of SEQ ID NO. 310, and a third amino acid sequence being at least 70%, optionally at least 80%, preferably at least 85%, more preferably at least 90% and most preferably at least 95% homologous to a polypeptide sequence corresponding to amino acids 677-685 of SEQ ID NO. 310, wherein said first amino acid sequence, bridging amino acid, second amino acid sequence and third amino acid sequence are contiguous and in a sequential order.

According to preferred embodiments of the present invention, there is provided an isolated polypeptide encoding for a tail of SEQ ID NO. 310, comprising a polypeptide being at least 70%, optionally at least about 80%, preferably at least about 85%, more preferably at least about 90% and most preferably at least about 95% homologous to the sequence EHGRGPGKT (SEQ ID NO:419) in SEQ ID NO. 310.

According to preferred embodiments of the present invention, there is provided an isolated chimeric polypeptide encoding for SEQ ID NO. 311, comprising a first amino acid sequence being at least 90% homologous to amino acids 1-42 of SEQ ID NO. 346, which also corresponds to amino acids 1-42 of SEQ ID NO. 311, a bridging amino acid N corresponding to amino acid 43 of SEQ ID NO. 311, a second amino acid sequence being at least 90% homologous to amino acids 44-657 of SEQ ID NO. 346, which also corresponds to amino acids 44-657 of SEQ ID NO. 311, and a third amino acid sequence being at least 70%, optionally at least 80%, preferably at least 85%, more preferably at least 90% and most preferably at least 95% homologous to a polypeptide sequence corresponding to amino acids 658-696 of SEQ ID NO. 311, wherein said first amino acid sequence, bridging amino acid, second amino acid sequence and third amino acid sequence are contiguous and in a sequential order.

According to preferred embodiments of the present invention, there is provided an isolated polypeptide encoding for a tail of SEQ ID NO. 311, comprising a polypeptide being at least 70%, optionally at least about 80%, preferably at least about 85%, more preferably at least about 90% and most preferably at least about 95% homologous to the sequence GPGRHAGNAGTLTQSLDCDAGVPPPAFQ-PLSTSYIYFSE (SEQ ID NO:420) in SEQ ID NO. 311.

According to preferred embodiments of the present invention, there is provided an isolated chimeric polypeptide encoding for SEQ ID NO. 312, comprising a first amino acid sequence being at least 90% homologous to amino acids 1-42 of SEQ ID NO. 346, which also corresponds to amino acids 1-42 of SEQ ID NO. 312, a bridging amino acid N corresponding to amino acid 43 of SEQ ID NO. 312, a second amino acid sequence being at least 90% homologous to amino acids 44-610 of SEQ ID NO. 346, which also corresponds to amino acids 44-610 of SEQ ID NO. 312, and a third amino acid sequence being at least 70%, optionally at least 80%, preferably at least 85%, more preferably at least 90% and most preferably at least 95% homologous to a polypeptide having the sequence AMH corresponding to amino acids 611-613 of SEQ ID NO. 312, wherein said first amino acid sequence, bridging amino acid, second amino acid sequence and third amino acid sequence are contiguous and in a sequential order.

According to preferred embodiments of the present invention, there is provided an isolated chimeric polypeptide encoding for SEQ ID NO. 305, comprising a first amino acid sequence being at least 90% homologous to amino acids 1-381 of SEQ ID NO. 347, which also corresponds to amino acids 1-381 of SEQ ID NO. 305, and a second amino acid sequence being at least 70%, optionally at least 80%, preferably at least 85%, more preferably at least 90% and most preferably at least 95% homologous to a polypeptide sequence corresponding to amino acids 382-387 of SEQ ID NO. 305, wherein said first amino acid sequence and second amino acid sequence are contiguous and in a sequential order.

According to preferred embodiments of the present invention, there is provided an isolated polypeptide encoding for a tail of SEQ ID NO. 305, comprising a polypeptide being at least 70%, optionally at least about 80%, preferably at least about 85%, more preferably at least about 90% and most preferably at least about 95% homologous to the sequence TSLSLS (SEQ ID NO:415) in SEQ ID NO. 305.

According to preferred embodiments of the present invention, there is provided an isolated chimeric polypeptide encoding for SEQ ID NO. 306, comprising a first amino acid sequence being at least 90% homologous to amino acids 1-338 of SEQ ID NO. 347, which also corresponds to amino acids 1-338 of SEQ ID NO. 306, and a second amino acid sequence being at least 70%, optionally at least 80%, preferably at least 85%, more preferably at least 90% and most preferably at least 95% homologous to a polypeptide sequence corresponding to amino acids 339-346 of SEQ ID NO. 306, wherein said first amino acid sequence and second amino acid sequence are contiguous and in a sequential order.

According to preferred embodiments of the present invention, there is provided an isolated polypeptide encoding for a tail of SEQ ID NO. 306, comprising a polypeptide being at least 70%, optionally at least about 80%, preferably at least about 85%, more preferably at least about 90% and most preferably at least about 95% homologous to the sequence VLLCAQWP (SEQ ID NO:416) in SEQ ID NO. 306.

According to preferred embodiments of the present invention, there is provided an isolated chimeric polypeptide encoding for SEQ ID NO. 307, comprising a first amino acid sequence being at least 90% homologous to amino acids 1-223 of SEQ ID NO. 347, which also corresponds to amino acids 1-223 of SEQ ID NO. 307, and a second amino acid sequence being at least 70%, optionally at least 80%, preferably at least 85%, more preferably at least 90% and most preferably at least 95% homologous to a polypeptide having the sequence A corresponding to amino acids 224-224 of SEQ ID NO. 307, wherein said first amino acid sequence and second amino acid sequence are contiguous and in a sequential order.

According to preferred embodiments of the present invention, there is provided an isolated chimeric polypeptide encoding for SEQ ID NO. 308, comprising a first amino acid sequence being at least 90% homologous to amino acids 1-294 of SEQ ID NO. 347, which also corresponds to amino acids 1-294 of SEQ ID NO. 308, and a second amino acid sequence being at least 70%, optionally at least 80%, preferably at least 85%, more preferably at least 90% and most preferably at least 95% homologous to a polypeptide sequence corresponding to amino acids 295-304 of SEQ ID NO. 308, wherein said first amino acid sequence and second amino acid sequence are contiguous and in a sequential order.

According to preferred embodiments of the present invention, there is provided an isolated polypeptide encoding for a tail of SEQ ID NO. 308, comprising a polypeptide being at least 70%, optionally at least about 80%, preferably at least about 85%, more preferably at least about 90% and most preferably at least about 95% homologous to the sequence RCYLRFLDIY (SEQ ID NO:417) in SEQ ID NO. 308.

According to preferred embodiments of the present invention, there is provided an isolated chimeric polypeptide encoding for SEQ ID NO. 281, comprising a first amino acid sequence being at least 70%, optionally at least 80%, preferably at least 85%, more preferably at least 90% and most preferably at least 95% homologous to a amino acids 1-116 of FABH_HUMAN (SEQ ID NO:348), which also corresponds to amino acids 1-116 of SEQ ID NO. 281, and a second amino acid sequence being at least 70%, optionally at least 80%, preferably at least 85%, more preferably at least 90% and most preferably at least 95% homologous to a polypeptide sequence corresponding to amino acids 117-215 of SEQ ID NO. 281, wherein said first and second amino acid sequences are contiguous and in a sequential order.

According to preferred embodiments of the present invention, there is provided an isolated polypeptide encoding for a tail of SEQ ID NO. 281, comprising a polypeptide being at least 70%, optionally at least about 80%, preferably at least about 85%, more preferably at least about 90% and most preferably at least about 95% homologous to the sequence VRWATLELYLIGYYYCSFSQACSKKPSP-PLRAVEAGTREWLWVRVVSGGNFLCSGFGL TQAGT-QILPYRLHDCGQITFSKCNCKTGINNTNLVGLLGSL (SEQ ID NO:396) in SEQ ID NO. 281.

According to preferred embodiments of the present invention, there is provided an isolated chimeric polypeptide encoding for SEQ ID NO. 281, comprising a first amino acid sequence being at least 90% homologous to amino acids 1-116 of AAP35373 (SEQ ID NO:348), which also corresponds to amino acids 1-116 of SEQ ID NO. 281, and a second amino acid sequence being at least 70%, optionally at least 80%, preferably at least 85%, more preferably at least 90% and most preferably at least 95% homologous to a polypeptide sequence corresponding to amino acids 117-215 of SEQ ID NO. 281, wherein said first and second amino acid sequences are contiguous and in a sequential order.

According to preferred embodiments of the present invention, there is provided an isolated polypeptide encoding for a tail of SEQ ID NO. 281, comprising a polypeptide being at least 70%, optionally at least about 80%, preferably at least about 85%, more preferably at least about 90% and most preferably at least about 95% homologous to the sequence VRWATLELYLIGYYYCSFSQACSKKPSP-PLRAVEAGTREWLWVRVVSGGNFLCSGFGL TQAGT-QILPYRLHDCGQITFSKCNCKTGINNTNLVGLLGSL (SEQ ID NO:396) in SEQ ID NO. 281.

According to preferred embodiments of the present invention, there is provided an isolated chimeric polypeptide encoding for SEQ ID NO. 282, comprising a first amino acid sequence being at least 70%, optionally at least 80%, preferably at least 85%, more preferably at least 90% and most preferably at least 95% homologous to a polypeptide sequence corresponding to amino acids 1-116 of FABH_HUMAN (SEQ ID NO:348), which also corresponds to amino acids 1-116 of SEQ ID NO. 282, and a second amino acid sequence being at least 70%, optionally at least 80%, preferably at least 85%, more preferably at least 90% and most preferably at least 95% homologous to a polypeptide sequence corresponding to amino acids 117-178 of SEQ ID NO. 282, wherein said first and second amino acid sequences are contiguous and in a sequential order.

According to preferred embodiments of the present invention, there is provided an isolated polypeptide encoding for a tail of SEQ ID NO. 282, comprising a polypeptide being at least 70%, optionally at least about 80%, preferably at least about 85%, more preferably at least about 90% and most preferably at least about 95% homologous to the sequence DVLTAWPSIYRRQVKVLREDEITILP-WHLQWSREKATKLLRPTLPSYNNHGWEELRVG KSIV (SEQ ID NO:397) in SEQ ID NO. 282.

According to preferred embodiments of the present invention, there is provided an isolated chimeric polypeptide encoding for SEQ ID NO. 282, comprising a first amino acid sequence being at least 90% homologous to amino acids 1-116 of AAP35373 (SEQ ID NO:348), which also corresponds to amino acids 1-116 of SEQ ID NO. 282, and a second amino acid sequence being at least 70%, optionally at least 80%, preferably at least 85%, more preferably at least 90% and most preferably at least 95% homologous to a polypeptide sequence corresponding to amino acids 117-178 of SEQ ID NO. 282, wherein said first and second amino acid sequences are contiguous and in a sequential order.

According to preferred embodiments of the present invention, there is provided an isolated polypeptide encoding for a tail of SEQ ID NO. 282, comprising a polypeptide being at least 70%, optionally at least about 80%, preferably at least about 85%, more preferably at least about 90% and most preferably at least about 95% homologous to the sequence DVLTAWPSIYRRQVKVLREDEITILP-WHLQWSREKATKLLRPTLPSYNNHGWEELRVG KSIV (SEQ ID NO:397) in SEQ ID NO. 282.

According to preferred embodiments of the present invention, there is provided an isolated chimeric polypeptide encoding for SEQ ID NO. 283, comprising a first amino acid sequence being at least 70%, optionally at least 80%, preferably at least 85%, more preferably at least 90% and most preferably at least 95% homologous to a polypeptide having the sequence amino acids 1-116 of FABH_HUMAN (SEQ ID NO:348), which also corresponds to amino acids 1-116 of SEQ ID NO. 283, and a second amino acid sequence being at least 70%, optionally at least 80%, preferably at least 85%, more preferably at least 90% and most preferably at least 95% homologous to a polypeptide sequence corresponding to amino acids 117-126 of SEQ ID NO. 283, wherein said first and second amino acid sequences are contiguous and in a sequential order.

According to preferred embodiments of the present invention, there is provided an isolated polypeptide encoding for a tail of SEQ ID NO. 283, comprising a polypeptide being at least 70%, optionally at least about 80%, preferably at least about 85%, more preferably at least about 90% and most preferably at least about 95% homologous to the sequence MEKLQLRNVK (SEQ ID NO:398) in SEQ ID NO. 283.

According to preferred embodiments of the present invention, there is provided an isolated chimeric polypeptide encoding for SEQ ID NO. 283, comprising a first amino acid sequence being at least 90% homologous to amino acids 1-116 of AAP35373 (SEQ ID NO:348), which also corresponds to amino acids SEQ ID NO. 283, and a second amino acid sequence being at least 70%, optionally at least 80%, preferably at least 85%, more preferably at least 90% and most preferably at least 95% homologous to a polypeptide sequence corresponding to amino acids 117-126 of SEQ ID NO. 283, wherein said first and second amino acid sequences are contiguous and in a sequential order.

According to preferred embodiments of the present invention, there is provided an isolated polypeptide encoding for a tail of SEQ ID NO. 283, comprising a polypeptide being at least 70%, optionally at least about 80%, preferably at least about 85%, more preferably at least about 90% and most preferably at least about 95% homologous to the sequence MEKLQLRNVK (SEQ ID NO:398) in SEQ ID NO. 283.

According to preferred embodiments of the present invention, there is provided an isolated chimeric polypeptide encoding for SEQ ID NO. 284, comprising a first amino acid sequence being at least 90% homologous to amino acids 1-24 of FABH_HUMAN (SEQ ID NO:348), which also corresponds to amino acids 1-24 of SEQ ID NO. 284, second amino acid sequence being at least 70%, optionally at least 80%, preferably at least 85%, more preferably at least 90% and most preferably at least 95% homologous to a polypeptide sequence corresponding to amino acids 25-35 of SEQ ID NO. 284, and a third amino acid sequence being at least 90% homologous to amino acids 25-133 of FABH_HUMAN (SEQ ID NO:348), which also corresponds to amino acids 36-144 of SEQ ID NO. 284, wherein said first, second, third and fourth amino acid sequences are contiguous and in a sequential order.

According to preferred embodiments of the present invention, there is provided an isolated polypeptide encoding for an edge portion of SEQ ID NO. 284, comprising an amino acid sequence being at least 70%, optionally at least about 80%, preferably at least about 85%, more preferably at least about 90% and most preferably at least about 95% homologous to the sequence encoding for AHILITFPLPS (SEQ ID NO:399), corresponding to SEQ ID NO. 284.

According to preferred embodiments of the present invention, there is provided an isolated chimeric polypeptide encoding for SEQ ID NO. 284, comprising a first amino acid sequence being at least 90% homologous to amino acids 1-24 of AAP35373 (SEQ ID NO:348), which also corresponds to amino acids 1-24 of SEQ ID NO. 284, second amino acid sequence being at least 70%, optionally at least 80%, preferably at least 85%, more preferably at least 90% and most preferably at least 95% homologous to a polypeptide sequence corresponding to amino acids 25-35 of SEQ ID NO. 284, and a third amino acid sequence being at least 90% homologous to amino acids 25-133 of AAP35373 (SEQ ID NO:348), which also corresponds to amino acids 36-144 of SEQ ID NO. 284, wherein said first, second and third amino acid sequences are contiguous and in a sequential order.

According to preferred embodiments of the present invention, there is provided an isolated polypeptide encoding for an edge portion of SEQ ID NO. 284, comprising an amino acid sequence being at least 70%, optionally at least about 80%, preferably at least about 85%, more preferably at least about 90% and most preferably at least about 95% homologous to the sequence encoding for AHILITFPLPS (SEQ ID NO:399), corresponding to SEQ ID NO. 284.

According to preferred embodiments of the present invention, there is provided an isolated chimeric polypeptide encoding for SEQ ID NO. 285, comprising a first amino acid sequence being at least 90% homologous to amino acids 1-203 of SEQ ID NO. 349, which also corresponds to amino acids 1-203 of SEQ ID NO. 285, and a second amino acid sequence being at least 70%, optionally at least 80%, preferably at least 85%, more preferably at least 90% and most preferably at least 95% homologous to a polypeptide sequence corresponding to amino acids 204-240 of SEQ ID NO. 285, wherein said first and second amino acid sequences are contiguous and in a sequential order.

According to preferred embodiments of the present invention, there is provided an isolated polypeptide encoding for a tail of SEQ ID NO. 285, comprising a polypeptide being at least 70%, optionally at least about 80%, preferably at least about 85%, more preferably at least about 90% and most preferably at least about 95% homologous to the sequence LWLTPVIPTLWEADGGGLHEPWSWRPA-WATWLQRNYL (SEQ ID NO:400) in SEQ ID NO. 285.

According to preferred embodiments of the present invention, there is provided an isolated chimeric polypeptide encoding for SEQ ID NO. 286, comprising a first amino acid sequence being at least 90% homologous to amino acids 1-78 of SEQ ID NO. 349, which also corresponds to amino acids 1-78 of SEQ ID NO. 286, second amino acid sequence being at least 70%, optionally at least 80%, preferably at least 85%, more preferably at least 90% and most preferably at least 95% homologous to a polypeptide sequence corresponding to amino acids 79-125 of SEQ ID NO. 286, and a third amino acid sequence being at least 90% homologous to amino acids 79-399 of SEQ ID NO. 349, which also corresponds to amino acids 126-446 of SEQ ID NO. 286, wherein said first, second and third amino acid sequences are contiguous and in a sequential order.

According to preferred embodiments of the present invention, there is provided an isolated polypeptide encoding for an edge portion of SEQ ID NO. 286, comprising an amino acid sequence being at least 70%, optionally at least about 80%, preferably at least about 85%, more preferably at least about 90% and most preferably at least about 95% homologous to the sequence encoding for HWQISQWWLHFQT-PREEGKMKLLELSESADGAAWKRWGGNSNTHRIQ (SEQ ID NO:401), corresponding to SEQ ID NO. 286.

According to preferred embodiments of the present invention, there is provided an isolated chimeric polypeptide encoding for SEQ ID NO. 287, comprising a first amino acid sequence being at least 90% homologous to amino acids 1-140 of SEQ ID NO. 349, which also corresponds to amino acids 1-140 of SEQ ID NO. 287, and a second amino acid sequence being at least 90% homologous to amino acids 203-399 of SEQ ID NO. 349, which also corresponds to amino acids 141-337 of SEQ ID NO. 287, wherein said first and second amino acid sequences are contiguous and in a sequential order.

According to preferred embodiments of the present invention, there is provided an isolated chimeric polypeptide encoding for an edge portion of SEQ ID NO. 287, comprising a polypeptide having a length "n", wherein "n" is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DV, having a structure as follows: a sequence starting from any of amino acid numbers 140−x to 140; and ending at any of amino acid numbers 141+((n−2)−x), in which x varies from 0 to n−2.

According to preferred embodiments of the present invention, there is provided an isolated chimeric polypeptide encoding for SEQ ID NO. 288, comprising a first amino acid sequence being at least 70%, optionally at least 80%, preferably at least 85%, more preferably at least 90% and most preferably at least 95% homologous to a polypeptide sequence corresponding to amino acids 1-10 of SEQ ID NO. 288, second amino acid sequence being at least 90% homologous to amino acids 18-106 of SEQ ID NO. 349, which also corresponds to amino acids 11-99 of SEQ ID NO. 288, a third (bridging) amino acid sequence comprising D, and a fourth amino acid sequence being at least 90% homologous to amino acids 179-399 of SEQ ID NO. 349, which also corresponds to amino acids 101-321 of SEQ ID NO. 288, wherein said first, second, third and fourth amino acid sequences are contiguous and in a sequential order.

According to preferred embodiments of the present invention, there is provided an isolated polypeptide encoding for a head of SEQ ID NO. 288, comprising a polypeptide being at least 70%, optionally at least about 80%, preferably at least about 85%, more preferably at least about 90% and most preferably at least about 95% homologous to the sequence NETEAEQSYV (SEQ ID NO:402) of SEQ ID NO. 288.

According to preferred embodiments of the present invention, there is provided an isolated polypeptide encoding for an edge portion of SEQ ID NO. 288, comprising a polypeptide having a length "n", wherein "n" is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LDY having a structure as follows (numbering according to SEQ ID NO. 288): a sequence starting from any of amino acid numbers 99−x to 99; and ending at any of amino acid numbers 101+((n−2)−x), in which x varies from 0 to n−2.

According to preferred embodiments of the present invention, there is provided an isolated chimeric polypeptide encoding for SEQ ID NO. 289, comprising a first amino acid sequence being at least 70%, optionally at least 80%, preferably at least 85%, more preferably at least 90% and most preferably at least 95% homologous to a polypeptide sequence corresponding to amino acids 1-15 of SEQ ID NO. 289, and a second amino acid sequence being at least 90% homologous to corresponding to amino acids 203-399 of SEQ ID NO. 349, which also corresponds to amino acids 16-212 of SEQ ID NO. 289, wherein said first and second amino acid sequences are contiguous and in a sequential order.

According to preferred embodiments of the present invention, there is provided an isolated polypeptide encoding for a head of SEQ ID NO. 289, comprising a polypeptide being at least 70%, optionally at least about 80%, preferably at least about 85%, more preferably at least about 90% and most preferably at least about 95% homologous to the sequence MSSWLSAGSPSSLSV (SEQ ID NO:403) of SEQ ID NO. 289.

According to preferred embodiments of the present invention, there is provided an isolated chimeric polypeptide encoding for SEQ ID NO. 290, comprising a first amino acid sequence being at least 70%, optionally at least 80%, preferably at least 85%, more preferably at least 90% and most preferably at least 95% homologous to a polypeptide sequence corresponding to amino acids 1-13 of SEQ ID NO. 290, and a second amino acid sequence being at least 90% homologous to amino acids 280-399 of SEQ ID NO. 349, which also corresponds to amino acids 14-133 of SEQ ID NO. 290, wherein said first and second amino acid sequences are contiguous and in a sequential order.

According to preferred embodiments of the present invention, there is provided an isolated polypeptide encoding for a head of SEQ ID NO. 290, comprising a polypeptide being at least 70%, optionally at least about 80%, preferably at least about 85%, more preferably at least about 90% and most preferably at least about 95% homologous to the sequence MCRGYSTLLNPVS (SEQ ID NO:404) of SEQ ID NO. 290.

According to preferred embodiments of the present invention, there is provided an isolated chimeric polypeptide encoding for SEQ ID NO. 291, comprising a first amino acid sequence being at least 90% homologous to amino acids 1-246 of SEQ ID NO. 349, which also corresponds to amino acids 1-246 of SEQ ID NO. 291, and a second amino acid sequence being at least 70%, optionally at least 80%, preferably at least 85%, more preferably at least 90% and most preferably at least 95% homologous to a polypeptide sequence corresponding to amino acids 247-252 of SEQ ID NO. 291, wherein said first and second amino acid sequences are contiguous and in a sequential order.

According to preferred embodiments of the present invention, there is provided an isolated polypeptide encoding for a tail of SEQ ID NO. 291, comprising a polypeptide being at least 70%, optionally at least about 80%, preferably at least about 85%, more preferably at least about 90% and most preferably at least about 95% homologous to the sequence SRNWTQ (SEQ ID NO:405) in SEQ ID NO. 291.

According to preferred embodiments of the present invention, there is provided an isolated chimeric polypeptide encoding for SEQ ID NO. 292, comprising a first amino acid sequence being at least 70%, optionally at least 80%, preferably at least 85%, more preferably at least 90% and most preferably at least 95% homologous to a polypeptide sequence corresponding to amino acids 1-10 of SEQ ID NO. 292, second amino acid sequence being at least 90% homologous to amino acids 26-276 of Q96NF5 (SEQ ID NO:362), which also corresponds to amino acids 11-261 of SEQ ID NO. 292, followed by A, and a third amino acid sequence being at least 90% homologous to amino acids 278-466 of Q96NF5 (SEQ ID NO:362), which also corresponds to amino acids 263-451 of SEQ ID NO. 292, wherein said first, second, A, and third amino acid sequences are contiguous and in a sequential order.

According to preferred embodiments of the present invention, there is provided an isolated polypeptide encoding for a head of SEQ ID NO. 292, comprising a polypeptide being at least 70%, optionally at least about 80%, preferably at least about 85%, more preferably at least about 90% and most preferably at least about 95% homologous to the sequence MEISLVKCSE (SEQ ID NO:406) of SEQ ID NO. 292

According to preferred embodiments of the present invention, there is provided an isolated chimeric polypeptide encoding for SEQ ID NO. 293, comprising a first amino acid sequence being at least 90% homologous to amino acids 1-276 of Q96NF5 (SEQ ID NO:362), which also corresponds to amino acids 1-276 of SEQ ID NO. 293, followed by A, a second amino acid sequence being at least 90% homologous to amino acids 278-372 of Q96NF5 (SEQ ID NO:362), which also corresponds to amino acids 278-372 of SEQ ID NO. 293, and a third amino acid sequence being at least 90% homologous to amino acids 401-466 of Q96NF5 (SEQ ID NO:362), which also corresponds to amino acids 373-438 of SEQ ID NO. 293, wherein said first, A, second, and third amino acid sequences are contiguous and in a sequential order.

According to preferred embodiments of the present invention, there is provided an isolated chimeric polypeptide encoding for an edge portion of SEQ ID NO. 293, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EE, having a structure as follows: a sequence starting from any of amino acid numbers 372–x to 372; and ending at any of amino acid numbers 373+((n–2)–x), in which x varies from 0 to n–2.

According to preferred embodiments of the present invention, there is provided an isolated chimeric polypeptide encoding for SEQ ID NO. 294, comprising a first amino acid sequence being at least 90% homologous to amino acids 1-276 of Q96NF5 (SEQ ID NO:362), which also corresponds to amino acids 1-276 of SEQ ID NO. 294, followed by A, a second amino acid sequence being at least 90% homologous to amino acids 278-401 of Q96NF5 (SEQ ID NO:362), which also corresponds to amino acids 278-401 of SEQ ID NO. 294, and a third amino acid sequence being at least 70%, optionally at least 80%, preferably at least 85%, more preferably at least 90% and most preferably at least 95% homologous to a polypeptide sequence corresponding to amino acids 402-407 of SEQ ID NO. 294, wherein said first, A, second and third amino acid sequences are contiguous and in a sequential order.

According to preferred embodiments of the present invention, there is provided an isolated polypeptide encoding for a tail of SEQ ID NO. 294, comprising a polypeptide being at least 70%, optionally at least about 80%, preferably at least about 85%, more preferably at least about 90% and most preferably at least about 95% homologous to the sequence PNRQDS (SEQ ID NO:407) in SEQ ID NO. 294.

According to preferred embodiments of the present invention, there is provided an isolated chimeric polypeptide encoding for SEQ ID NO. 295, comprising a first amino acid sequence being at least 90% homologous to amino acids 1-276 of Q96NF5 (SEQ ID NO:362), which also corresponds to amino acids 1-276 of SEQ ID NO. 295, followed by A, a second amino acid sequence being at least 90% homologous to amino acids 278-374 of Q96NF5 (SEQ ID NO:362), which also corresponds to amino acids 278-374 of SEQ ID NO. 295, and a third amino acid sequence being at least 70%, optionally at least 80%, preferably at least 85%, more preferably at least 90% and most preferably at least 95% homologous to a polypeptide sequence corresponding to amino acids 375-390 of SEQ ID NO. 295, wherein said first, A, second and third amino acid sequences are contiguous and in a sequential order.

According to preferred embodiments of the present invention, there is provided an isolated polypeptide encoding for a tail of SEQ ID NO. 295, comprising a polypeptide being at least 70%, optionally at least about 80%, preferably at least about 85%, more preferably at least about 90% and most preferably at least about 95% homologous to the sequence MSHELFSRFSLRLFGR (SEQ ID NO:408) in SEQ ID NO. 295.

According to preferred embodiments of the present invention, there is provided an isolated chimeric polypeptide encoding for SEQ ID NO. 296, comprising a first amino acid sequence being at least 90% homologous to amino acids 1-261 of Q96NF5 (SEQ ID NO:362), which also corresponds to amino acids 1-261 of SEQ ID NO. 296, a second amino acid sequence comprising A, and a third amino acid sequence being at least 90% homologous to amino acids 263-451 of Q96NF5 (SEQ ID NO:362), which also corresponds to amino acids 263-451 of SEQ ID NO. 296, wherein said first, second and third amino acid sequences are contiguous and in a sequential order.

According to preferred embodiments of the present invention, there is provided an isolated chimeric polypeptide encoding for SEQ ID NO. 297, comprising a first amino acid sequence being at least 90% homologous to amino acids 1-132 of Q9NPI5 (SEQ ID NO:372), which also corresponds to amino acids 1-132 of SEQ ID NO. 297, and a second amino acid sequence being at least 70%, optionally at least 80%, preferably at least 85%, more preferably at least 90% and most preferably at least 95% homologous to a polypeptide sequence corresponding to amino acids 133-145 of SEQ ID NO. 297, wherein said first and second amino acid sequences are contiguous and in a sequential order.

According to preferred embodiments of the present invention, there is provided an isolated polypeptide encoding for a tail of SEQ ID NO. 297, comprising a polypeptide being at least 70%, optionally at least about 80%, preferably at least about 85%, more preferably at least about 90% and most preferably at least about 95% homologous to the sequence LPGRHEVPRGALP (SEQ ID NO:409) in SEQ ID NO. 297.

According to preferred embodiments of the present invention, there is provided an isolated chimeric polypeptide encoding for SEQ ID NO. 297, comprising a first amino acid sequence being at least 90% homologous to amino acids 1-109 of Q9NZK3 (SEQ ID NO:373), which also corresponds to amino acids 1-109 of SEQ ID NO. 297, and a second amino acid sequence being at least 70%, optionally at least 80%, preferably at least 85%, more preferably at least 90% and most preferably at least 95% homologous to a polypeptide sequence corresponding to amino acids 110-145 of SEQ ID NO. 297, wherein said first and second amino acid sequences are contiguous and in a sequential order.

According to preferred embodiments of the present invention, there is provided an isolated polypeptide encoding for a tail of SEQ ID NO. 297, comprising a polypeptide being at least 70%, optionally at least about 80%, preferably at least about 85%, more preferably at least about 90% and most preferably at least about 95% homologous to the sequence LVDLYSRRYFLTVPYEECKWRRSLPGRHEVPRGALP in SEQ ID NO. 297.

According to preferred embodiments of the present invention, there is provided an isolated chimeric polypeptide encoding for SEQ ID NO. 298, comprising a first amino acid sequence being at least 90% homologous to amino acids 1-107 of Q9NPI5 (SEQ ID NO:372), which also corresponds to amino acids 1-107 of SEQ ID NO. 298, and a second amino acid sequence being at least 70%, optionally at least 80%, preferably at least 85%, more preferably at least 90% and most preferably at least 95% homologous to a polypeptide sequence corresponding to amino acids 108-121 of SEQ ID NO. 298, wherein said first and second amino acid sequences are contiguous and in a sequential order.

According to preferred embodiments of the present invention, there is provided an isolated polypeptide encoding for a tail of SEQ ID NO. 298, comprising a polypeptide being at least 70%, optionally at least about 80%, preferably at least about 85%, more preferably at least about 90% and most preferably at least about 95% homologous to the sequence NLPGRHEVPRGALP (SEQ ID NO:410) in SEQ ID NO. 298.

According to preferred embodiments of the present invention, there is provided an isolated chimeric polypeptide encoding for SEQ ID NO. 298, comprising a first amino acid sequence being at least 90% homologous to amino acids 1-107 of Q9NZK3 (SEQ ID NO:373), which also corresponds to amino acids 1-107 of SEQ ID NO. 298, and a second amino acid sequence being at least 70%, optionally at least 80%, preferably at least 85%, more preferably at least 90% and most preferably at least 95% homologous to a polypeptide sequence corresponding to amino acids 108-121 of SEQ ID NO. 298, wherein said first and second amino acid sequences are contiguous and in a sequential order.

According to preferred embodiments of the present invention, there is provided an isolated polypeptide encoding for a tail of SEQ ID NO. 298, comprising a polypeptide being at least 70%, optionally at least about 80%, preferably at least about 85%, more preferably at least about 90% and most preferably at least about 95% homologous to the sequence NLPGRHEVPRGALP (SEQ ID NO:410) in SEQ ID NO. 298.

According to preferred embodiments of the present invention, there is provided an isolated chimeric polypeptide encoding for SEQ ID NO. 299, comprising a first amino acid sequence being at least 90% homologous to amino acids 51-151 of SEQ ID NO. 350, which also corresponds to amino acids 1-101 of SEQ ID NO. 299.

According to preferred embodiments of the present invention, there is provided an isolated chimeric polypeptide encoding for SEQ ID NO. 300, comprising a first amino acid sequence being at least 70%, optionally at least 80%, preferably at least 85%, more preferably at least 90% and most preferably at least 95% homologous to a polypeptide having the sequence MSSFSTTT (SEQ ID NO:411) corresponding to amino acids 1-8 of SEQ ID NO. 300, and a second amino acid sequence being at least 90% homologous to amino acids 42-151 of SEQ ID NO. 350, which also corresponds to amino acids 9-118 of SEQ ID NO. 300, wherein said first and second amino acid sequences are contiguous and in a sequential order.

According to preferred embodiments of the present invention, there is provided an isolated polypeptide encoding for a head of SEQ ID NO. 300, comprising a polypeptide being at least 70%, optionally at least about 80%, preferably at least about 85%, more preferably at least about 90% and most preferably at least about 95% homologous to the sequence MSSFSTTT (SEQ ID NO:411) of SEQ ID NO. 300.

According to preferred embodiments of the present invention, there is provided an isolated chimeric polypeptide encoding for SEQ ID NO. 301, comprising a first amino acid sequence being at least 90% homologous to amino acids 1-124 of TRIC_HUMAN, which also corresponds to amino acids 1-124 of SEQ ID NO. 301, and a second amino acid sequence being at least 70%, optionally at least 80%, preferably at least 85%, more preferably at least 90% and most preferably at least 95% homologous to a polypeptide sequence corresponding to amino acids 125-137 of SEQ ID NO. 301, wherein said first and second amino acid sequences are contiguous and in a sequential order.

According to preferred embodiments of the present invention, there is provided an isolated polypeptide encoding for a tail of SEQ ID NO. 301, comprising a polypeptide being at least 70%, optionally at least about 80%, preferably at least about 85%, more preferably at least about 90% and most preferably at least about 95% homologous to the sequence VGRMGSSGTFGVG (SEQ ID NO:412) in SEQ ID NO. 301.

According to preferred embodiments of the present invention, there is provided an isolated chimeric polypeptide encoding for SEQ ID NO. 302, comprising a first amino acid sequence being at least 90% homologous to amino acids 1-8 of TRIC_HUMAN, which also corresponds to amino acids 1-8 of SEQ ID NO. 302, and a second amino acid sequence being at least 70%, optionally at least 80%, preferably at least 85%, more preferably at least 90% and most preferably at least 95% homologous to a polypeptide sequence corresponding to amino acids 36-209 of TRIC_HUMAN, which also corresponding to amino acids 9-182 of SEQ ID NO. 302, wherein said first and second amino acid sequences are contiguous and in a sequential order.

According to preferred embodiments of the present invention, there is provided an isolated chimeric polypeptide encoding for an edge portion of SEQ ID NO. 302, comprising a polypeptide having a length "n", wherein "n" is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AK, having a structure as follows: a sequence starting from any of amino acid numbers 8−x to 8; and ending at any of amino acid numbers 9+((n−2)−x), in which x varies from 0 to n−2.

According to preferred embodiments of the present invention, there is provided an isolated chimeric polypeptide encoding for SEQ ID NO. 303, comprising a first amino acid sequence being at least 90% homologous to amino acids 1-36 of TRIC_HUMAN, which also corresponds to amino acids 1-36 of SEQ ID NO. 303, and a second amino acid sequence being at least 70%, optionally at least 80%, preferably at least 85%, more preferably at least 90% and most preferably at least 95% homologous to a polypeptide sequence corresponding to amino acids 37-86 of SEQ ID NO. 303, wherein said first and second amino acid sequences are contiguous and in a sequential order.

According to preferred embodiments of the present invention, there is provided an isolated polypeptide encoding for a tail of SEQ ID NO. 303, comprising a polypeptide being at least 70%, optionally at least about 80%, preferably at least about 85%, more preferably at least about 90% and most preferably at least about 95% homologous to the sequence VGRGFLGAEYRRRRDPRPWEWGEEPGLR-RGRGLRGGASGAEFCRGSCSDW (SEQ ID NO:413) in SEQ ID NO. 303.

According to preferred embodiments of the present invention, there is provided an isolated chimeric polypeptide encoding for SEQ ID NO. 304, comprising a first amino acid sequence being at least 90% homologous to amino acids 1-8 of TRIC_HUMAN, which also corresponds to amino acids 1-8 of SEQ ID NO. 304, and a second amino acid sequence being at least 70%, optionally at least 80%, preferably at least 85%, more preferably at least 90% and most preferably at least 95% homologous to a polypeptide sequence corresponding to amino acids 9-13 of SEQ ID NO. 304, wherein said first and second amino acid sequences are contiguous and in a sequential order.

According to preferred embodiments of the present invention, there is provided an isolated polypeptide encoding for a tail of SEQ ID NO. 304, comprising a polypeptide being at least 70%, optionally at least about 80%, preferably at least about 85%, more preferably at least about 90% and most preferably at least about 95% homologous to the sequence VRAAG (SEQ ID NO:414) in SEQ ID NO. 304.

According to preferred embodiments of the present invention, there is provided an antibody capable of specifically binding to an epitope of an amino acid sequence in any one of cluster S67314, N56180, T10377, Z24874, HUMCD-DANF, HUMTROPIA, HUMSMCK, H88495, Z36249, FLJ26352, HSACMHCP. Preferably, the amino acid sequence corresponds to any insertion, including a bridge, edge portion, tail, or head as described herein.

Preferably, the antibody is capable of differentiating between a splice variant having the epitope and a corresponding known protein.

According to preferred embodiments of the present invention, there is provided a kit for detecting heart disorders, comprising a kit detecting overexpression of a splice variant. Optionally, the kit comprises a NAT-based technology. Preferably, the kit further comprises at least one primer pair capable of selectively hybridizing to a nucleic acid sequence in any one of cluster S67314, N56180, T10377, Z24874, HUMCDDANF, HUMTROPIA, HUMSMCK, H88495, Z36249, FLJ26352, HSACMHCP.

Optionally, the kit further comprises at least one oligonucleotide capable of selectively hybridizing to a nucleic acid sequence in any one of cluster S67314, N56180, T10377, Z24874, HUMCDDANF, HUMTROPIA, HUMSMCK, H88495, Z36249, FLJ26352, HSACMHCP.

Optionally, kit comprises an antibody as described herein. Preferably, the kit further comprises at least one reagent for performing an ELISA or a Western blot.

According to preferred embodiments of the present invention, there is provided a method for detecting heart disorders, comprising detecting overexpression of a splice variant of any of cluster S67314, N56180, T10377, Z24874, HUM-CDDANF, HUMTROPIA, HUMSMCK, H88495, Z36249, FLJ26352, HSACMHCP. Optionally, detecting overexpression is performed with a NAT-based technology.

Also optionally, detecting overexpression is performed with an immunoassay. Preferably, the immunoassay comprises an antibody as described herein.

According to preferred embodiments of the present invention, there is provided a biomarker capable of detecting heart disorders, comprising any of the above nucleic acid sequences or a fragment thereof, or amino acid sequences or a fragment thereof.

According to preferred embodiments of the present invention, there is provided a method for screening for heart disorders, comprising detecting cardiac disease cells or tissue with a biomarker or an antibody.

According to preferred embodiments of the present invention, there is provided a method for diagnosing heart disorders, comprising detecting heart cells or tissue with a biomarker or an antibody.

According to preferred embodiments of the present invention, there is provided a method for monitoring disease progression, or treatment efficacy, or relapse of heart disorders, or any combination thereof, comprising detecting heart cells or tissue with a biomarker or an antibody or a method or assay as described herein.

According to preferred embodiments of the present invention, there is provided a method of selecting a therapy for heart disorders, comprising detecting heart disorder cells with a biomarker or an antibody or a method or assay as described herein and selecting a therapy according to the detection.

A heart disorder and/or cardiac disease and/or cardiac pathology optionally comprises at least one of: Myocardial infarct, ungina pectoris (stable and unstable), cardiomyopathy, myocarditis, congestive heart failure, the detection of reinfarction, the detection of success of thrombolytic therapy after Myocardial infarct, Myocardial infarct after surgery, assessing the size of infarct in Myocardial infarct.

According to preferred embodiments of the present invention, preferably any of the above nucleic acid and/or amino acid sequences further comprises any sequence having at least about 70%, preferably at least about 80%, more preferably at least about 90%, most preferably at least about 95% homology thereto.

All nucleic acid sequences and/or amino acid sequences shown herein as embodiments of the present invention relate to their isolated form, as isolated polynucleotides (including for all transcripts), oligonucleotides (including for all segments, amplicons and primers), peptides (including for all tails, bridges, insertions or heads, optionally including other antibody epitopes as described herein) and/or polypeptides (including for all proteins). It should be noted that oligonucleotide and polynucleotide, or peptide and polypeptide, may optionally be used interchangeably.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). All of these are hereby incorporated by

BRIEF DESCRIPTION OF DRAWINGS

FIG. 1 shows a schematic summary of quantitative real-time PCR analysis.

FIG. 2 is a histogram showing expression of ESTs in each category, as "parts per million".

FIGS. 3 & 4 are histograms showing expression of oligonucleotides in various tissues, prob 205738_s_at (SEQ ID NO:392) & prob 214285_at (SEQ ID NO:393).

FIG. 15 is a histogram concerning the expression of the number of heart-specific clones in libraries/sequences.

FIG. 16 is a histogram concerning the actual expression of oligonucleotides in various tissues, prob 221051_s_at (SEQ ID NO:392), including heart.

FIG. 17A is a histogram concerning the expressions of ESTs in number of heart tissue-specific clones in libraries/sequences;

FIG. 17B is a histogram concerning the actual expression of oligonucleotides in various tissues, prob 209957_s-at (SEQ ID NO:392), including heart tissue.

FIG. 19 is a histogram concerning expression of ESTs, the number of heart tissue-specific clones in libraries/sequences FIG. 20 is a histogram concerning the actual expression of oligonucleotides in various tissues, prob 205742_at (SEQ ID NO:393), including heart tissue.

FIG. 21A is a histogram showing specific expression of the TRIC_HUMAN Troponin I, cardiac muscle HUMTROPIA transcripts in sequence HUMTROPIA seg22 in heart tissue (SEQ ID NO:382).

FIG. 35 shows Troponin PCR product sequence (nucleotides 80-466 of SEQ ID NO:25).

FIG. 37 shows the complete sequence of the plasmid shown in FIG. 36 (SEQ ID NO:386).

FIG. 38 shows the protein sequence of Troponin variant HUMTROPIA_PEA_2 T7, with the HIS-tag marked (SEQ ID NO:387).

DESCRIPTION OF PREFERRED EMBODIMENTS

Figure 5A:
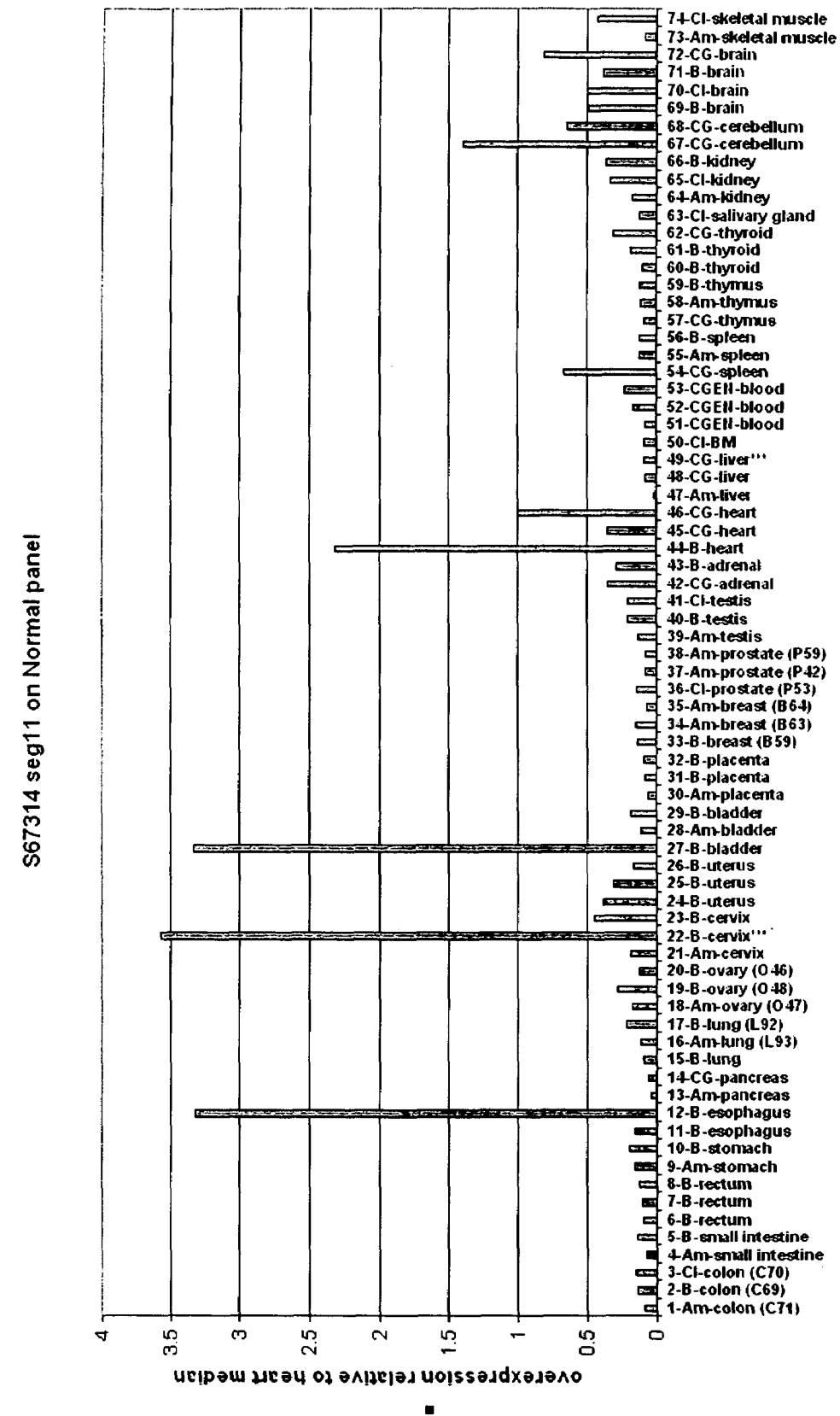
FIG. 5A is a histogram showing specific expression of variant FABH_HUMAN Fatty acid-binding protein transcripts in heart tissue samples as opposed to other tissues (SEQ ID NO:63).

The present invention is of novel markers for cardiac disease that are both sensitive and accurate. Biomolecular sequences (amino acid and/or nucleic acid sequences) uncovered using the methodology of the present invention and described herein can be efficiently utilized as tissue or pathological markers and/or as drugs or drug targets for treating or preventing a disease.

These markers are specifically released to the bloodstream under conditions of cardiac disease and/or cardiac pathology, including but not limited to cardiac damage, and/or are otherwise expressed at a much higher level and/or specifically expressed in heart. The method of the present invention identifies clusters (genes) which are characterized in that the transcripts are differentially expressed in heart muscle tissue compared with other normal tissues, preferably in comparison to skeletal muscle tissue. In acute conditions under which heart muscle tissue experiences hypoxia (with or without necrosis), intracellular proteins that are not normally secreted can leak through the cell membrane to the extracellular space. Therefore, heart muscle tissue differentially expressed proteins, as through analysis of EST expression, are potential acute heart damage markers.

Leakage of intracellular content can also occur in chronic damage to the heart muscle, therefore proteins selected according to this method are potential markers for chronic heart conditions. When a protein that is differentially expressed in heart muscle is secreted, it is even more likely to be useful as a chronic heart damage marker, since secretion implies that the protein has a physiological role exterior to the cell, and therefore may be used by the heart muscle to respond to the chronic damage. This rationale is empirically supported by the non-limiting examples of the proteins BNP (brain natriuretic peptide) and ANF (atrial natriuretic factor), which are differentially expressed heart muscle proteins that are secreted and which were shown to be markers for congestive heart failure. In addition, BNP and ANF are not only differentially expressed in heart tissue, they are also overexpressed dramatically (hundreds of times greater expression) when heart failure occurs. Other heart specific secreted proteins might present similar overexpression in chronic damage.

Optionally and preferably, the markers described herein are overexpressed in heart as opposed to muscle, as described in greater detail below. The measurement of these markers, alone or in combination, in patient samples provides information that the diagnostician can correlate with a probable diagnosis of cardiac disease and/or cardiac pathology, including but not limited to cardiac damage.

The present invention therefore also relates to diagnostic assays for cardiac disease and/or cardiac pathology, including but not limited to cardiac damage, and methods of use of such markers for detection of cardiac disease and/or cardiac pathology, including but not limited to cardiac damage (alone or in combination), optionally and preferably in a sample taken from a subject (patient), which is more preferably some type of blood sample.

The present invention therefore also relates to diagnostic assays for cardiac disease and/or cardiac pathology, including but not limited to cardiac damage, and methods of use of such markers for detection of cardiac disease and/or cardiac pathology, including but not limited to cardiac damage (alone or in combination), optionally and preferably in a sample taken from a subject (patient), which is more preferably some type of blood sample.

In another embodiment, the present invention relates to bridges, tails, heads and/or insertions, and/or analogs, homologs and derivatives of such peptides. Such bridges, tails, heads and/or insertions are described in greater detail below with regard to the Examples.

As used herein a "tail" refers to a peptide sequence at the end of an amino acid sequence that is unique to a splice variant according to the present invention. Therefore, a splice variant having such a tail may optionally be considered as a chimera, in that at least a first portion of the splice variant is typically highly homologous (often 100% identical) to a portion of the corresponding known protein, while at least a second portion of the variant comprises the tail.

As used herein a "head" refers to a peptide sequence at the beginning of an amino acid sequence that is unique to a splice variant according to the present invention. Therefore, a splice variant having such a head may optionally be considered as a chimera, in that at least a first portion of the splice variant comprises the head, while at least a second portion is typically highly homologous (often 100% identical) to a portion of the corresponding known protein.

As used herein "an edge portion" refers to a connection between two portions of a splice variant according to the present invention that were not joined in the wild type or known protein. An edge may optionally arise due to a join between the above "known protein" portion of a variant and the tail, for example, and/or may occur if an internal portion of the wild type sequence is no longer present, such that two portions of the sequence are now contiguous in the splice variant that were not contiguous in the known protein. A "bridge" may optionally be an edge portion as described above, but may also include a join between a head and a "known protein" portion of a variant, or a join between a tail and a "known protein" portion of a variant, or a join between an insertion and a "known protein" portion of a variant.

Optionally and preferably, a bridge between a tail or a head or a unique insertion, and a "known protein" portion of a variant, comprises at least about 10 amino acids, more preferably at least about 20 amino acids, most preferably at least about 30 amino acids, and even more preferably at least about 40 amino acids, in which at least one amino acid is from the tail/head/insertion and at least one amino acid is from the "known protein" portion of a variant. Also optionally, the bridge may comprise any number of amino acids from about 10 to about 40 amino acids (for example, 10, 11, 12, 13 . . . 37, 38, 39, 40 amino acids in length, or any number in between).

It should be noted that a bridge cannot be extended beyond the length of the sequence in either direction, and it should be assumed that every bridge description is to be read in such manner that the bridge length does not extend beyond the sequence itself.

Furthermore, bridges are described with regard to a sliding window in certain contexts below. For example, certain descriptions of the bridges feature the following format: a bridge between two edges (in which a portion of the known protein is not present in the variant) may optionally be described as follows: a bridge portion of CONTIG-NAME_P1 (representing the name of the protein), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise XX (2 amino acids in the center of the bridge, one from each end of the edge), having a structure as follows (numbering according to the sequence of CONTIG-NAME_P1): a sequence starting from any of amino acid numbers 49−x to 49 (for example); and ending at any of amino acid numbers 50+((n−2)−x) (for example), in which x varies from 0 to n−2. In this example, it should also be read as including bridges in which n is any number of amino acids between 10-50 amino acids in length. Furthermore, the bridge polypeptide cannot extend beyond the sequence, so it should be read such that 49−x (for example) is not less than 1, nor 50+((n−2)−x) (for example) greater than the total sequence length.

In another embodiment, this invention provides antibodies specifically recognizing the splice variants and polypeptide fragments thereof of this invention. Preferably such antibodies differentially recognize splice variants of the present invention but do not recognize a corresponding known protein (such known proteins are discussed with regard to their splice variants in the Examples below).

In another embodiment, this invention provides an isolated nucleic acid molecule encoding for a splice variant according to the present invention, having a nucleotide sequence as set forth in any one of the sequences listed herein, or a sequence complementary thereto. In another embodiment, this invention provides an isolated nucleic acid molecule, having a nucleotide sequence as set forth in any one of the sequences listed herein, or a sequence complementary thereto. In another embodiment, this invention provides an oligonucleotide of at least about 12 nucleotides, specifically hybridizable with the nucleic acid molecules of this invention. In another embodiment, this invention provides vectors, cells, liposomes and compositions comprising the isolated nucleic acids of this invention.

In another embodiment, this invention provides a method for detecting a splice variant according to the present invention in a biological sample, comprising: contacting a biological sample with an antibody specifically recognizing a splice variant according to the present invention under conditions whereby the antibody specifically interacts with the splice variant in the biological sample but do not recognize known corresponding proteins (wherein the known protein is discussed with regard to its splice variant(s) in the Examples below), and detecting said interaction; wherein the presence of an interaction correlates with the presence of a splice variant in the biological sample.

In another embodiment, this invention provides a method for detecting a splice variant nucleic acid sequences in a biological sample, comprising: hybridizing the isolated nucleic acid molecules or oligonucleotide fragments of at least about a minimum length to a nucleic acid material of a biological sample and detecting a hybridization complex; wherein the presence of a hybridization complex correlates with the presence of a splice variant nucleic acid sequence in the biological sample.

According to the present invention, the splice variants described herein are non-limiting examples of markers for diagnosing cardiac disease and/or cardiac pathology, including but not limited to cardiac damage. Each splice variant marker of the present invention can be used alone or in combination, for various uses, including but not limited to, prognosis, prediction, screening, early diagnosis, determination of progression, therapy selection and treatment monitoring of cardiac disease and/or cardiac pathology, including but not limited to cardiac damage.

According to optional but preferred embodiments of the present invention, any marker according to the present invention may optionally be used alone or combination. Such a combination may optionally comprise a plurality of markers described herein, optionally including any subcombination of markers, and/or a combination featuring at least one other marker, for example a known marker. Furthermore, such a combination may optionally and preferably be used as described above with regard to determining a ratio between a quantitative or semi-quantitative measurement of any marker described herein to any other marker described herein, and/or any other known marker, and/or any other marker. With regard to such a ratio between any marker described herein (or a combination thereof) and a known marker, more preferably the known marker comprises the "known protein" as described in greater detail below with regard to each cluster or gene.

According to other preferred embodiments of the present invention, a splice variant protein or a fragment thereof, or a splice variant nucleic acid sequence or a fragment thereof, may be featured as a biomarker for detecting cardiac disease and/or cardiac pathology, including but not limited to cardiac damage, such that a biomarker may optionally comprise any of the above. According to still other preferred embodiments, the present invention optionally and preferably encompasses any amino acid sequence or fragment thereof encoded by a nucleic acid sequence corresponding to a splice variant protein as described herein. Any oligopeptide or peptide relating to such an amino acid sequence or fragment thereof may optionally also (additionally or alternatively) be used as a biomarker, including but not limited to the unique amino acid sequences of these proteins that are depicted as tails, heads, insertions, edges or bridges. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to a splice variant of the present invention as described above, optionally for any application.

Non-limiting examples of methods or assays are described below.

The present invention also relates to kits based upon such diagnostic methods or assays.

Nucleic Acid Sequences and Oligonucleotides

Various embodiments of the present invention encompass nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or artificially induced, either randomly or in a targeted fashion.

The present invention encompasses nucleic acid sequences described herein; fragments thereof, sequences hybridizable therewith, sequences homologous thereto [e.g., at least 50%, at least 55%, at least 60%, at least 65%, at least 70%, at least 75%, at least 80%, at least 85%, at least 95% or more say 100% identical to the nucleic acid sequences set forth below], sequences encoding similar polypeptides with different codon usage, altered sequences characterized by mutations, such as deletion, insertion or substitution of one or more nucleotides, either naturally occurring or man induced, either randomly or in a targeted fashion. The present invention also encompasses homologous nucleic acid sequences (i.e., which form a part of a polynucleotide sequence of the present invention) which include sequence regions unique to the polynucleotides of the present invention.

In cases where the polynucleotide sequences of the present invention encode previously unidentified polypeptides, the present invention also encompasses novel polypeptides or portions thereof, which are encoded by the isolated polynucleotide and respective nucleic acid fragments thereof described hereinabove.

A "nucleic acid fragment" or an "oligonucleotide" or a "polynucleotide" are used herein interchangeably to refer to a polymer of nucleic acids. A polynucleotide sequence of the present invention refers to a single or double stranded nucleic acid sequences which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is composed of genomic and cDNA sequences. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Preferred embodiments of the present invention encompass oligonucleotide probes.

An example of an oligonucleotide probe which can be utilized by the present invention is a single stranded polynucleotide which includes a sequence complementary to the unique sequence region of any variant according to the present invention, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Alternatively, an oligonucleotide probe of the present invention can be designed to hybridize with a nucleic acid sequence encompassed by any of the above nucleic acid sequences, particularly the portions specified above, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Oligonucleotides designed according to the teachings of the present invention can be generated according to any oligonucleotide synthesis method known in the art such as enzymatic synthesis or solid phase synthesis. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988) and "Oligonucleotide Synthesis" Gait, M. J., ed. (1984) utilizing solid phase chemistry, e.g. cyanoethyl phosphoramidite followed by deprotection, desalting and purification by for example, an automated trityl-on method or HPLC.

Oligonucleotides used according to this aspect of the present invention are those having a length selected from a range of about 10 to about 200 bases preferably about 15 to about 150 bases, more preferably about 20 to about 100 bases, most preferably about 20 to about 50 bases. Preferably, the oligonucleotide of the present invention features at least 17, at least 18, at least 19, at least 20, at least 22, at least 25, at least 30 or at least 40, bases specifically hybridizable with the biomarkers of the present invention.

The oligonucleotides of the present invention may comprise heterocylic nucleosides consisting of purines and the pyrimidines bases, bonded in a 3' to 5' phosphodiester linkage.

Preferably used oligonucleotides are those modified at one or more of the backbone, internucleoside linkages or bases, as is broadly described hereinunder.

Specific examples of preferred oligonucleotides useful according to this aspect of the present invention include oligonucleotides containing modified backbones or non-natural internucleoside linkages. Oligonucleotides having modified backbones include those that retain a phosphorus atom in the backbone, as disclosed in U.S. Pat. Nos. 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Preferred modified oligonucleotide backbones include, for example, phosphorothioates, chiral phosphorothioates, phosphorodithioates, phosphotriesters, aminoalkyl phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms can also be used.

Alternatively, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts, as disclosed in U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

Other oligonucleotides which can be used according to the present invention, are those modified in both sugar and the internucleoside linkage, i.e., the backbone, of the nucleotide units are replaced with novel groups. The base units are maintained for complementation with the appropriate polynucleotide target. An example for such an oligonucleotide mimetic, includes peptide nucleic acid (PNA). United States patents that teach the preparation of PNA compounds include, but are not limited to, U.S. Pat. Nos. 5,539,082; 5,714,331; and 5,719,262, each of which is herein incorporated by reference. Other backbone modifications, which can be used in the present invention are disclosed in U.S. Pat. No. 6,303,374.

Oligonucleotides of the present invention may also include base modifications or substitutions. As used herein, "unmodified" or "natural" bases include the purine bases adenine (A) and guanine (G), and the pyrimidine bases thymine (T), cytosine (C) and uracil (U). Modified bases include but are not limited to other synthetic and natural bases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further bases particularly useful for increasing the binding affinity of the oligomeric compounds of the invention include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. and are presently preferred base substitutions, even more particularly when combined with 2'-O-methoxyethyl sugar modifications.

Another modification of the oligonucleotides of the invention involves chemically linking to the oligonucleotide one or more moieties or conjugates, which enhance the activity, cellular distribution or cellular uptake of the oligonucleotide. Such moieties include but are not limited to lipid moieties such as a cholesterol moiety, cholic acid, a thioether, e.g., hexyl-S-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxycholesterol moiety, as disclosed in U.S. Pat. No. 6,303,374.

It is not necessary for all positions in a given oligonucleotide molecule to be uniformly modified, and in fact more than one of the aforementioned modifications may be incorporated in a single compound or even at a single nucleoside within an oligonucleotide.

It will be appreciated that oligonucleotides of the present invention may include further modifications for more efficient use as diagnostic agents and/or to increase bioavailability, therapeutic efficacy and reduce cytotoxicity.

To enable cellular expression of the polynucleotides of the present invention, a nucleic acid construct according to the present invention may be used, which includes at least a coding region of one of the above nucleic acid sequences, and further includes at least one cis acting regulatory element. As used herein, the phrase "cis acting regulatory element" refers to a polynucleotide sequence, preferably a promoter, which binds a trans acting regulator and regulates the transcription of a coding sequence located downstream thereto.

Any suitable promoter sequence can be used by the nucleic acid construct of the present invention.

Preferably, the promoter utilized by the nucleic acid construct of the present invention is active in the specific cell population transformed. Examples of cell type-specific and/or tissue-specific promoters include promoters such as albumin that is liver specific, lymphoid specific promoters [Calame et al., (1988) Adv. Immunol. 43:235-275]; in particular promoters of T-cell receptors [Winoto et al., (1989) EMBO J. 8:729-733] and immunoglobulins; [Banerji et al. (1983) Cell 33729-740], neuron-specific promoters such as the neurofilament promoter [Byrne et al. (1989) Proc. Natl. Acad. Sci. USA 86:5473-5477], pancreas-specific promoters [Edlunch et al. (1985) Science 230:912-916] or mammary gland-specific promoters such as the milk whey promoter (U.S. Pat. No. 4,873,316 and European Application Publication No. 264,166). The nucleic acid construct of the present invention can further include an enhancer, which can be adjacent or distant to the promoter sequence and can function in up regulating the transcription therefrom.

The nucleic acid construct of the present invention preferably further includes an appropriate selectable marker and/or an origin of replication. Preferably, the nucleic acid construct utilized is a shuttle vector, which can propagate both in E. coli (wherein the construct comprises an appropriate selectable marker and origin of replication) and be compatible for propagation in cells, or integration in a gene and a tissue of choice. The construct according to the present invention can be, for example, a plasmid, a bacmid, a phagemid, a cosmid, a phage, a virus or an artificial chromosome.

Examples of suitable constructs include, but are not limited to, pcDNA3, pcDNA3.1 (+/−), pGL3, PzeoSV2 (+/−), pDisplay, pEF/myc/cyto, pCMV/myc/cyto each of which is commercially available from Invitrogen Co. (dot invitrogen dot com). Examples of retroviral vector and packaging systems are those sold by Clontech, San Diego, Calif., including Retro-X vectors pLNCX and pLXSN, which permit cloning into multiple cloning sites and the trasgene is transcribed from CMV promoter. Vectors derived from Mo-MuLV are also included such as pBabe, where the transgene will be transcribed from the 5'LTR promoter.

Currently preferred in vivo nucleic acid transfer techniques include transfection with viral or non-viral constructs, such as adenovirus, lentivirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. The most preferred constructs for use in gene therapy are viruses, most preferably adenoviruses, AAV, lentiviruses, or retroviruses. A viral construct such as a retroviral construct includes at least one transcriptional promoter/enhancer or locus-defining element(s), or other elements that control gene expression by other means such as alternate splicing, nuclear RNA export, or post-translational modification of messenger. Such vector constructs also include a packaging signal, long terminal repeats (LTRs) or portions thereof, and positive and negative strand primer binding sites appropriate to the virus used, unless it is already present in the viral construct. In addition, such a construct typically includes a signal sequence for secretion of the peptide from a host cell in which it is placed. Preferably the signal sequence for this purpose is a mammalian signal sequence or the signal sequence of the polypeptide variants of the present invention. Optionally, the construct may also include a signal that directs polyadenylation, as well as one or more restriction sites and a translation termination sequence. By way of example, such constructs will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

Hybridization Assays

Detection of a nucleic acid of interest in a biological sample may optionally be effected by hybridization-based assays using an oligonucleotide probe (non-limiting examples of probes according to the present invention were previously described).

Traditional hybridization assays include PCR, RT-PCR, Real-time PCR, RNase protection, in-situ hybridization, primer extension, Southern blots (DNA detection), dot or slot blots (DNA, RNA), and Northern blots (RNA detection) (NAT type assays are described in greater detail below). More recently, PNAs have been described (Nielsen et al. 1999, Current Opin. Biotechnol. 10:71-75). Other detection methods include kits containing probes on a dipstick setup and the like.

Hybridization based assays which allow the detection of a variant of interest (i.e., DNA or RNA) in a biological sample rely on the use of oligonucleotides which can be 10, 15, 20, or 30 to 100 nucleotides long preferably from 10 to 50, more preferably from 40 to 50 nucleotides long.

Thus, the isolated polynucleotides (oligonucleotides) of the present invention are preferably hybridizable with any of the herein described nucleic acid sequences under moderate to stringent hybridization conditions.

Moderate to stringent hybridization conditions are characterized by a hybridization solution such as containing 10% dextrane sulfate, 1 M NaCl, 1% SDS and 5×10$^6$ cpm $^{32}$P labeled probe, at 65° C., with a final wash solution of 0.2×SSC and 0.1% SDS and final wash at 65° C. and whereas moderate hybridization is effected using a hybridization solution containing 10% dextrane sulfate, 1 M NaCl, 1% SDS and 5×10$^6$ cpm $^{32}$P labeled probe, at 65° C., with a final wash solution of 1×SSC and 0.1% SDS and final wash at 50° C.

More generally, hybridization of short nucleic acids (below 200 bp in length, e.g. 17-40 bp in length) can be effected using the following exemplary hybridization protocols which can be modified according to the desired stringency; (i) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 1-1.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$; (ii) hybridization solution of 6×SSC and 0.1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 2-2.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$, final wash solution of 6×SSC, and final wash at 22° C.; (iii) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature.

The detection of hybrid duplexes can be carried out by a number of methods. Typically, hybridization duplexes are separated from unhybridized nucleic acids and the labels bound to the duplexes are then detected. Such labels refer to radioactive, fluorescent, biological or enzymatic tags or labels of standard use in the art. A label can be conjugated to either the oligonucleotide probes or the nucleic acids derived from the biological sample.

Probes can be labeled according to numerous well known methods. Non-limiting examples of radioactive labels include 3H, 14C, 32P, and 35S. Non-limiting examples of detectable markers include ligands, fluorophores, chemiluminescent agents, enzymes, and antibodies. Other detectable markers for use with probes, which can enable an increase in sensitivity of the method of the invention, include biotin and radio-nucleotides. It will become evident to the person of ordinary skill that the choice of a particular label dictates the manner in which it is bound to the probe.

For example, oligonucleotides of the present invention can be labeled subsequent to synthesis, by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, when fluorescently-labeled oligonucleotide probes are used, fluorescein, lissamine, phycoerythrin, rhodamine (Perkin Elmer Cetus), Cy2, Cy3, Cy3.5, Cy5, Cy5.5, Cy7, Fluor X (Amersham) and others [e.g., Kricka et al. (1992), Academic Press San Diego, Calif.] can be attached to the oligonucleotides.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays. For instance, samples may be hybridized to an irrelevant probe and treated with RNAse A prior to hybridization, to assess false hybridization.

Although the present invention is not specifically dependent on the use of a label for the detection of a particular nucleic acid sequence, such a label might be beneficial, by increasing the sensitivity of the detection. Furthermore, it enables automation. Probes can be labeled according to numerous well known methods.

As commonly known, radioactive nucleotides can be incorporated into probes of the invention by several methods. Non-limiting examples of radioactive labels include $^3$H, $^{14}$C, $^{32}$P, and $^{35}$S.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays.

Probes of the invention can be utilized with naturally occurring sugar-phosphate backbones as well as modified backbones including phosphorothioates, dithionates, alkyl phosphonates and a-nucleotides and the like. Probes of the invention can be constructed of either ribonucleic acid (RNA) or deoxyribonucleic acid (DNA), and preferably of DNA.

NAT Assays

Detection of a nucleic acid of interest in a biological sample may also optionally be effected by NAT-based assays, which involve nucleic acid amplification technology, such as PCR for example (or variations thereof such as real-time PCR for example).

As used herein, a "primer" defines an oligonucleotide which is capable of annealing to (hybridizing with) a target sequence, thereby creating a double stranded region which can serve as an initiation point for DNA synthesis under suitable conditions.

Amplification of a selected, or target, nucleic acid sequence may be carried out by a number of suitable methods. See generally Kwoh et al., 1990, Am. Biotechnol. Lab. 8:14 Numerous amplification techniques have been described and can be readily adapted to suit particular needs of a person of ordinary skill. Non-limiting examples of amplification techniques include polymerase chain reaction (PCR), ligase chain reaction (LCR), strand displacement amplification (SDA), transcription-based amplification, the q3 replicase system and NASBA (Kwoh et al., 1989, Proc. NatI. Acad. Sci. USA 86, 1173-1177; Lizardi et al., 1988, BioTechnology 6:1197-1202; Malek et al., 1994, Methods Mol. Biol., 28:253-260; and Sambrook et al., 1989, supra).

The terminology "amplification pair" (or "primer pair") refers herein to a pair of oligonucleotides (oligos) of the present invention, which are selected to be used together in amplifying a selected nucleic acid sequence by one of a number of types of amplification processes, preferably a polymerase chain reaction. Other types of amplification processes include ligase chain reaction, strand displacement amplification, or nucleic acid sequence-based amplification, as explained in greater detail below. As commonly known in the art, the oligos are designed to bind to a complementary sequence under selected conditions.

In one particular embodiment, amplification of a nucleic acid sample from a patient is amplified under conditions which favor the amplification of the most abundant differentially expressed nucleic acid. In one preferred embodiment, RT-PCR is carried out on an mRNA sample from a patient under conditions which favor the amplification of the most abundant mRNA. In another preferred embodiment, the amplification of the differentially expressed nucleic acids is carried out simultaneously. It will be realized by a person skilled in the art that such methods could be adapted for the detection of differentially expressed proteins instead of differentially expressed nucleic acid sequences.

The nucleic acid (i.e. DNA or RNA) for practicing the present invention may be obtained according to well known methods.

Oligonucleotide primers of the present invention may be of any suitable length, depending on the particular assay format and the particular needs and targeted genomes employed. Optionally, the oligonucleotide primers are at least 12 nucleotides in length, preferably between 15 and 24 molecules, and they may be adapted to be especially suited to a chosen nucleic acid amplification system. As commonly known in the art, the oligonucleotide primers can be designed by taking into consideration the melting point of hybridization thereof with its targeted sequence (Sambrook et al., 1989, Molecular Cloning—A Laboratory Manual, 2nd Edition, CSH Laboratories; Ausubel et al., 1989, in Current Protocols in Molecular Biology, John Wiley & Sons Inc., N.Y.).

It will be appreciated that antisense oligonucleotides may be employed to quantify expression of a splice isoform of interest. Such detection is effected at the pre-mRNA level. Essentially the ability to quantitate transcription from a splice site of interest can be effected based on splice site accessibility. Oligonucleotides may compete with splicing factors for the splice site sequences. Thus, low activity of the antisense oligonucleotide is indicative of splicing activity.

The polymerase chain reaction and other nucleic acid amplification reactions are well known in the art (various non-limiting examples of these reactions are described in greater detail below). The pair of oligonucleotides according to this aspect of the present invention are preferably selected to have compatible melting temperatures (Tm), e.g., melting temperatures which differ by less than that 7° C., preferably less than 5° C., more preferably less than 4° C., most preferably less than 3° C., ideally between 3° C. and 0° C.

Polymerase Chain Reaction (PCR): The polymerase chain reaction (PCR), as described in U.S. Pat. Nos. 4,683,195 and 4,683,202 to Mullis and Mullis et al., is a method of increasing the concentration of a segment of target sequence in a mixture of genomic DNA without cloning or purification. This technology provides one approach to the problems of low target sequence concentration. PCR can be used to directly increase the concentration of the target to an easily detectable level. This process for amplifying the target sequence involves the introduction of a molar excess of two oligonucleotide primers which are complementary to their respective strands of the double-stranded target sequence to the DNA mixture containing the desired target sequence. The mixture is denatured and then allowed to hybridize. Following hybridization, the primers are extended with polymerase so as to form complementary strands. The steps of denaturation, hybridization (annealing), and polymerase extension (elongation) can be repeated as often as needed, in order to obtain relatively high concentrations of a segment of the desired target sequence.

The length of the segment of the desired target sequence is determined by the relative positions of the primers with respect to each other, and, therefore, this length is a controllable parameter. Because the desired segments of the target sequence become the dominant sequences (in terms of concentration) in the mixture, they are said to be "PCR-amplified."

Ligase Chain Reaction (LCR or LAR): The ligase chain reaction [LCR; sometimes referred to as "Ligase Amplification Reaction" (LAR)] has developed into a well-recognized alternative method of amplifying nucleic acids. In LCR, four oligonucleotides, two adjacent oligonucleotides which uniquely hybridize to one strand of target DNA, and a complementary set of adjacent oligonucleotides, which hybridize to the opposite strand are mixed and DNA ligase is added to the mixture. Provided that there is complete complementarity at the junction, ligase will covalently link each set of hybridized molecules. Importantly, in LCR, two probes are ligated together only when they base-pair with sequences in the target sample, without gaps or mismatches. Repeated cycles of denaturation, and ligation amplify a short segment of DNA. LCR has also been used in combination with PCR to achieve enhanced detection of single-base changes: see for example Segev, PCT Publication No. W09001069 A1 (1990). However, because the four oligonucleotides used in this assay can pair to form two short ligatable fragments, there is the potential for the generation of target-independent background signal. The use of LCR for mutant screening is limited to the examination of specific nucleic acid positions.

Self-Sustained Synthetic Reaction (3SR/NASBA): The self-sustained sequence replication reaction (3SR) is a transcription-based in vitro amplification system that can exponentially amplify RNA sequences at a uniform temperature. The amplified RNA can then be utilized for mutation detection. In this method, an oligonucleotide primer is used to add a phage RNA polymerase promoter to the 5' end of the sequence of interest. In a cocktail of enzymes and substrates that includes a second primer, reverse transcriptase, RNase H, RNA polymerase and ribo- and deoxyribonucleoside triphosphates, the target sequence undergoes repeated rounds of transcription, cDNA synthesis and second-strand synthesis to amplify the area of interest. The use of 3SR to detect mutations is kinetically limited to screening small segments of DNA (e.g., 200-300 base pairs).

Q-Beta (Qβ) Replicase: In this method, a probe which recognizes the sequence of interest is attached to the replicatable RNA template for Qβ replicase. A previously identified major problem with false positives resulting from the replication of unhybridized probes has been addressed through use of a sequence-specific ligation step. However, available thermostable DNA ligases are not effective on this RNA substrate, so the ligation must be performed by T4 DNA ligase at low temperatures (37 degrees C.). This prevents the use of high temperature as a means of achieving specificity as in the LCR, the ligation event can be used to detect a mutation at the junction site, but not elsewhere.

A successful diagnostic method must be very specific. A straight-forward method of controlling the specificity of nucleic acid hybridization is by controlling the temperature of the reaction. While the 3SR/NASBA, and Qβ systems are all able to generate a large quantity of signal, one or more of the enzymes involved in each cannot be used at high temperature (i.e., >55 degrees C.). Therefore the reaction temperatures cannot be raised to prevent non-specific hybridization of the probes. If probes are shortened in order to make them melt more easily at low temperatures, the likelihood of having more than one perfect match in a complex genome increases. For these reasons, PCR and LCR currently dominate the research field in detection technologies.

The basis of the amplification procedure in the PCR and LCR is the fact that the products of one cycle become usable templates in all subsequent cycles, consequently doubling the population with each cycle. The final yield of any such doubling system can be expressed as: $(1+X)^n=y$, where "X" is the mean efficiency (percent copied in each cycle), "n" is the number of cycles, and "y" is the overall efficiency, or yield of the reaction. If every copy of a target DNA is utilized as a template in every cycle of a polymerase chain reaction, then the mean efficiency is 100%. If 20 cycles of PCR are performed, then the yield will be $2^{20}$, or 1,048,576 copies of the starting material. If the reaction conditions reduce the mean efficiency to 85%, then the yield in those 20 cycles will be only $1.85^{20}$, or 220,513 copies of the starting material. In other words, a PCR running at 85% efficiency will yield only 21% as much final product, compared to a reaction running at 100% efficiency. A reaction that is reduced to 50% mean efficiency will yield less than 1% of the possible product.

In practice, routine polymerase chain reactions rarely achieve the theoretical maximum yield, and PCRs are usually run for more than 20 cycles to compensate for the lower yield. At 50% mean efficiency, it would take 34 cycles to achieve the million-fold amplification theoretically possible in 20, and at lower efficiencies, the number of cycles required becomes prohibitive. In addition, any background products that amplify with a better mean efficiency than the intended target will become the dominant products.

Also, many variables can influence the mean efficiency of PCR, including target DNA length and secondary structure, primer length and design, primer and dNTP concentrations, and buffer composition, to name but a few. Contamination of the reaction with exogenous DNA (e.g., DNA spilled onto lab surfaces) or cross-contamination is also a major consideration. Reaction conditions must be carefully optimized for each different primer pair and target sequence, and the process can take days, even for an experienced investigator. The laboriousness of this process, including numerous technical considerations and other factors, presents a significant drawback to using PCR in the clinical setting. Indeed, PCR has yet to penetrate the clinical market in a significant way. The same concerns arise with LCR, as LCR must also be optimized to use different oligonucleotide sequences for each target sequence. In addition, both methods require expensive equipment, capable of precise temperature cycling.

Many applications of nucleic acid detection technologies, such as in studies of allelic variation, involve not only detection of a specific sequence in a complex background, but also the discrimination between sequences with few, or single, nucleotide differences. One method of the detection of allele-specific variants by PCR is based upon the fact that it is difficult for Taq polymerase to synthesize a DNA strand when there is a mismatch between the template strand and the 3' end of the primer. An allele-specific variant may be detected by the use of a primer that is perfectly matched with only one of the possible alleles; the mismatch to the other allele acts to prevent the extension of the primer, thereby preventing the amplification of that sequence. This method has a substantial limitation in that the base composition of the mismatch influences the ability to prevent extension across the mismatch, and certain mismatches do not prevent extension or have only a minimal effect.

A similar 3'-mismatch strategy is used with greater effect to prevent ligation in the LCR. Any mismatch effectively blocks the action of the thermostable ligase, but LCR still has the drawback of target-independent background ligation products initiating the amplification. Moreover, the combination of PCR with subsequent LCR to identify the nucleotides at individual positions is also a clearly cumbersome proposition for the clinical laboratory.

The direct detection method according to various preferred embodiments of the present invention may be, for example a cycling probe reaction (CPR) or a branched DNA analysis.

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Recently devised techniques have sought to eliminate the use of radioactivity and/or improve the sensitivity in automatable formats. Two examples are the "Cycling Probe Reaction" (CPR), and "Branched DNA" (bDNA).

Cycling probe reaction (CPR): The cycling probe reaction (CPR), uses a long chimeric oligonucleotide in which a central portion is made of RNA while the two termini are made of DNA. Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may carried through sample preparation.

Branched DNA: Branched DNA (bDNA), involves oligonucleotides with branched structures that allow each individual oligonucleotide to carry 35 to 40 labels (e.g., alkaline phosphatase enzymes). While this enhances the signal from a hybridization event, signal from non-specific binding is similarly increased.

The detection of at least one sequence change according to various preferred embodiments of the present invention may be accomplished by, for example restriction fragment length polymorphism (RFLP analysis), allele specific oligonucleotide (ASO) analysis, Denaturing/Temperature Gradient Gel Electrophoresis (DGGE/TGGE), Single-Strand Conformation Polymorphism (SSCP) analysis or Dideoxy fingerprinting (ddF).

The demand for tests which allow the detection of specific nucleic acid sequences and sequence changes is growing rapidly in clinical diagnostics. As nucleic acid sequence data for genes from humans and pathogenic organisms accumulates, the demand for fast, cost-effective, and easy-to-use tests for as yet mutations within specific sequences is rapidly increasing.

A handful of methods have been devised to scan nucleic acid segments for mutations. One option is to determine the entire gene sequence of each test sample (e.g., a bacterial isolate). For sequences under approximately 600 nucleotides, this may be accomplished using amplified material (e.g., PCR reaction products). This avoids the time and expense associated with cloning the segment of interest. However, specialized equipment and highly trained personnel are required, and the method is too labor-intense and expensive to be practical and effective in the clinical setting.

In view of the difficulties associated with sequencing, a given segment of nucleic acid may be characterized on several other levels. At the lowest resolution, the size of the molecule can be determined by electrophoresis by comparison to a known standard run on the same gel. A more detailed picture of the molecule may be achieved by cleavage with combinations of restriction enzymes prior to electrophoresis, to allow construction of an ordered map. The presence of specific sequences within the fragment can be detected by hybridization of a labeled probe, or the precise nucleotide sequence can be determined by partial chemical degradation or by primer extension in the presence of chain-terminating nucleotide analogs.

Restriction fragment length polymorphism (RFLP): For detection of single-base differences between like sequences, the requirements of the analysis are often at the highest level of resolution. For cases in which the position of the nucleotide in question is known in advance, several methods have been developed for examining single base changes without direct sequencing. For example, if a mutation of interest happens to fall within a restriction recognition sequence, a change in the pattern of digestion can be used as a diagnostic tool (e.g., restriction fragment length polymorphism [RFLP] analysis).

Single point mutations have been also detected by the creation or destruction of RFLPs. Mutations are detected and localized by the presence and size of the RNA fragments generated by cleavage at the mismatches. Single nucleotide mismatches in DNA heteroduplexes are also recognized and cleaved by some chemicals, providing an alternative strategy to detect single base substitutions, generically named the "Mismatch Chemical Cleavage" (MCC). However, this method requires the use of osmium tetroxide and piperidine, two highly noxious chemicals which are not suited for use in a clinical laboratory.

RFLP analysis suffers from low sensitivity and requires a large amount of sample. When RFLP analysis is used for the detection of point mutations, it is, by its nature, limited to the detection of only those single base changes which fall within a restriction sequence of a known restriction endonuclease. Moreover, the majority of the available enzymes have 4 to 6 base-pair recognition sequences, and cleave too frequently for many large-scale DNA manipulations. Thus, it is applicable only in a small fraction of cases, as most mutations do not fall within such sites.

A handful of rare-cutting restriction enzymes with 8 base-pair specificities have been isolated and these are widely used in genetic mapping, but these enzymes are few in number, are limited to the recognition of G+C-rich sequences, and cleave at sites that tend to be highly clustered. Recently, endonucleases encoded by group I introns have been discovered that might have greater than 12 base-pair specificity, but again, these are few in number.

Allele specific oligonucleotide (ASO): If the change is not in a recognition sequence, then allele-specific oligonucleotides (ASOs), can be designed to hybridize in proximity to the mutated nucleotide, such that a primer extension or ligation event can bused as the indicator of a match or a mis-match. Hybridization with radioactively labeled allelic specific oligonucleotides (ASO) also has been applied to the detection of specific point mutations. The method is based on the differences in the melting temperature of short DNA fragments differing by a single nucleotide. Stringent hybridization and washing conditions can differentiate between mutant and wild-type alleles. The ASO approach applied to PCR products also has been extensively utilized by various researchers to detect and characterize point mutations in ras genes and gsp/gip oncogenes. Because of the presence of various nucleotide changes in multiple positions, the ASO method requires the use of many oligonucleotides to cover all possible oncogenic mutations.

With either of the techniques described above (i.e., RFLP and ASO), the precise location of the suspected mutation must be known in advance of the test. That is to say, they are inapplicable when one needs to detect the presence of a mutation within a gene or sequence of interest.

Denaturing/Temperature Gradient Gel Electrophoresis (DGGE/TGGE): Two other methods rely on detecting changes in electrophoretic mobility in response to minor sequence changes. One of these methods, termed "Denaturing Gradient Gel Electrophoresis" (DGGE) is based on the observation that slightly different sequences will display different patterns of local melting when electrophoretically resolved on a gradient gel. In this manner, variants can be distinguished, as differences in melting properties of homoduplexes versus heteroduplexes differing in a single nucleotide can detect the presence of mutations in the target sequences because of the corresponding changes in their electrophoretic mobilities. The fragments to be analyzed, usually PCR products, are "clamped" at one end by a long stretch of G-C base pairs (30-80) to allow complete denaturation of the sequence of interest without complete dissociation of the strands. The attachment of a GC "clamp" to the DNA fragments increases the fraction of mutations that can be recognized by DGGE. Attaching a GC clamp to one primer is critical to ensure that the amplified sequence has a low dissociation temperature. Modifications of the technique have been developed, using temperature gradients, and the method can be also applied to RNA:RNA duplexes.

Limitations on the utility of DGGE include the requirement that the denaturing conditions must be optimized for each type of DNA to be tested. Furthermore, the method requires specialized equipment to prepare the gels and maintain the needed high temperatures during electrophoresis. The expense associated with the synthesis of the clamping tail on one oligonucleotide for each sequence to be tested is also a major consideration. In addition, long running times are required for DGGE. The long running time of DGGE was shortened in a modification of DGGE called constant denaturant gel electrophoresis (CDGE). CDGE requires that gels be performed under different denaturant conditions in order to reach high efficiency for the detection of mutations.

A technique analogous to DGGE, termed temperature gradient gel electrophoresis (TGGE), uses a thermal gradient rather than a chemical denaturant gradient. TGGE requires the use of specialized equipment which can generate a temperature gradient perpendicularly oriented relative to the electrical field. TGGE can detect mutations in relatively small fragments of DNA therefore scanning of large gene segments requires the use of multiple PCR products prior to running the gel.

Single-Strand Conformation Polymorphism (SSCP): Another common method, called "Single-Strand Conformation Polymorphism" (SSCP) was developed by Hayashi, Sekya and colleagues and is based on the observation that single strands of nucleic acid can take on characteristic conformations in non-denaturing conditions, and these conformations influence electrophoretic mobility. The complementary strands assume sufficiently different structures that one strand may be resolved from the other. Changes in sequences within the fragment will also change the conformation, consequently altering the mobility and allowing this to be used as an assay for sequence variations.

The SSCP process involves denaturing a DNA segment (e.g., a PCR product) that is labeled on both strands, followed by slow electrophoretic separation on a nondenaturing polyacrylamide gel, so that intra-molecular interactions can form and not be disturbed during the run. This technique is extremely sensitive to variations in gel composition and temperature. A serious limitation of this method is the relative difficulty encountered in comparing data generated in different laboratories, under apparently similar conditions.

Dideoxy fingerprinting (ddF): The dideoxy fingerprinting (ddF) is another technique developed to scan genes for the presence of mutations. The ddF technique combines components of Sanger dideoxy sequencing with SSCP. A dideoxy sequencing reaction is performed using one dideoxy terminator and then the reaction products are electrophoresed on nondenaturing polyacrylamide gels to detect alterations in mobility of the termination segments as in SSCP analysis. While ddF is an improvement over SSCP in terms of increased sensitivity, ddF requires the use of expensive dideoxynucleotides and this technique is still limited to the analysis of fragments of the size suitable for SSCP (i.e., fragments of 200-300 bases for optimal detection of mutations).

In addition to the above limitations, all of these methods are limited as to the size of the nucleic acid fragment that can be analyzed. For the direct sequencing approach, sequences of greater than 600 base pairs require cloning, with the consequent delays and expense of either deletion sub-cloning or primer walking, in order to cover the entire fragment. SSCP and DGGE have even more severe size limitations. Because of reduced sensitivity to sequence changes, these methods are not considered suitable for larger fragments. Although SSCP is reportedly able to detect 90% of single-base substitutions within a 200 base-pair fragment, the detection drops to less than 50% for 400 base pair fragments. Similarly, the sensitivity of DGGE decreases as the length of the fragment reaches 500 base-pairs. The ddF technique, as a combination of direct sequencing and SSCP, is also limited by the relatively small size of the DNA that can be screened.

According to a presently preferred embodiment of the present invention the step of searching for any of the nucleic acid sequences described here, in tumor cells or in cells derived from a cancer patient is effected by any suitable technique, including, but not limited to, nucleic acid sequencing, polymerase chain reaction, ligase chain reaction, self-sustained synthetic reaction, Qβ-Replicase, cycling probe reaction, branched DNA, restriction fragment length polymorphism analysis, mismatch chemical cleavage, heteroduplex analysis, allele-specific oligonucleotides, denaturing gradient gel electrophoresis, constant denaturant gel electrophoresis, temperature gradient gel electrophoresis and dideoxy fingerprinting.

Detection may also optionally be performed with a chip or other such device. The nucleic acid sample which includes the candidate region to be analyzed is preferably isolated, amplified and labeled with a reporter group. This reporter group can be a fluorescent group such as phycoerythrin. The labeled nucleic acid is then incubated with the probes immobilized on the chip using a fluidics station. describe the fabrication of fluidics devices and particularly microcapillary devices, in silicon and glass substrates.

Once the reaction is completed, the chip is inserted into a scanner and patterns of hybridization are detected. The hybridization data is collected, as a signal emitted from the reporter groups already incorporated into the nucleic acid, which is now bound to the probes attached to the chip. Since the sequence and position of each probe immobilized on the chip is known, the identity of the nucleic acid hybridized to a given probe can be determined.

It will be appreciated that when utilized along with automated equipment, the above described detection methods can be used to screen multiple samples for a disease and/or pathological condition both rapidly and easily.

Amino Acid Sequences and Peptides

The terms "polypeptide," "peptide" and "protein" are used interchangeably herein to refer to a polymer of amino acid residues. The terms apply to amino acid polymers in which one or more amino acid residue is an analog or mimetic of a corresponding naturally occurring amino acid, as well as to naturally occurring amino acid polymers. Polypeptides can be modified, e.g., by the addition of carbohydrate residues to form glycoproteins. The terms "polypeptide," "peptide" and "protein" include glycoproteins, as well as non-glycoproteins.

Polypeptide products can be biochemically synthesized such as by employing standard solid phase techniques. Such methods include but are not limited to exclusive solid phase synthesis, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Solid phase polypeptide synthesis procedures are well known in the art and further described by John Morrow Stewart and Janis Dillaha Young, Solid Phase Peptide Syntheses (2nd Ed., Pierce Chemical Company, 1984).

Synthetic polypeptides can optionally be purified by preparative high performance liquid chromatography [Creighton T. (1983) Proteins, structures and molecular principles. WH Freeman and Co. N.Y.], after which their composition can be confirmed via amino acid sequencing.

In cases where large amounts of a polypeptide are desired, it can be generated using recombinant techniques such as described by Bitter et al., (1987) Methods in Enzymol. 153:516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

The present invention also encompasses polypeptides encoded by the polynucleotide sequences of the present invention, as well as polypeptides according to the amino acid sequences described herein. The present invention also encompasses homologues of these polypeptides, such homologues can be at least 50%, at least 55%, at least 60%, at least 65%, at least 70%, at least 75%, at least 80%, at least 85%, at least 95% or more say 100% homologous to the amino acid sequences set forth below, as can be determined using BlastP software of the National Center of Biotechnology Information (NCBI) using default parameters, optionally and preferably including the following: filtering on (this option filters repetitive or low-complexity sequences from the query using the Seg (protein) program), scoring matrix is BLOSUM62 for proteins, word size is 3, E value is 10, gap costs are 11, 1 (initialization and extension), and number of alignments shown is 50. Optionally and preferably, nucleic acid sequence homology (identity) is determined using BlastN software of the National Center of Biotechnology Information (NCBI) using default parameters, which preferably include using the DUST filter program, and also preferably include having an E value of 10, filtering low complexity sequences and a word size of 11. Finally, the present invention also encompasses fragments of the above described polypeptides and polypeptides having mutations, such as deletions, insertions or substitutions of one or more amino acids, either naturally occurring or artificially induced, either randomly or in a targeted fashion.

It will be appreciated that peptides identified according the present invention may be degradation products, synthetic peptides or recombinant peptides as well as peptidomimetics, typically, synthetic peptides and peptoids and semipeptoids which are peptide analogs, which may have, for example, modifications rendering the peptides more stable while in a body or more capable of penetrating into cells. Such modifications include, but are not limited to N terminus modification, C terminus modification, peptide bond modification, including, but not limited to, CH2-NH, CH2-S, CH2-S=O, O=C—NH, CH2-O, CH2-CH2, S=C—NH, CH=CH or CF=CH, backbone modifications, and residue modification. Methods for preparing peptidomimetic compounds are well known in the art and are specified. Further details in this respect are provided hereinunder.

Peptide bonds (—CO—NH—) within the peptide may be substituted, for example, by N-methylated bonds (—N(CH3)-CO—), ester bonds (—C(R)H—C—O—O—C(R)—N—), ketomethylen bonds (—CO—CH2-), α-aza bonds (—NH—N(R)—CO—), wherein R is any alkyl, e.g., methyl, carba bonds (—CH2-NH—), hydroxyethylene bonds (—CH(OH)—CH2-), thioamide bonds (—CS—NH—), olefinic double bonds (—CH=CH—), retro amide bonds (—NH—CO—), peptide derivatives (—N(R)—CH2-CO—), wherein R is the "normal" side chain, naturally presented on the carbon atom.

These modifications can occur at any of the bonds along the peptide chain and even at several (2-3) at the same time.

Natural aromatic amino acids, Trp, Tyr and Phe, may be substituted for synthetic non-natural acid such as Phenylglycine, TIC, naphthylelanine (Nol), ring-methylated derivatives of Phe, halogenated derivatives of Phe or o-methyl-Tyr.

In addition to the above, the peptides of the present invention may also include one or more modified amino acids or one or more non-amino acid monomers (e.g. fatty acids, complex carbohydrates etc).

As used herein in the specification and in the claims section below the term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids.

Table 1 non-conventional or modified amino acids which can be used with the present invention.

TABLE 1

| Non-conventional amino acid | Code | Non-conventional amino acid | Code |
|---|---|---|---|
| α-aminobutyric acid | Abu | L-N-methylalanine | Nmala |
| α-amino-α-methylbutyrate | Mgabu | L-N-methylarginine | Nmarg |
| aminocyclopropane- Carboxylate | Cpro | L-N-methylasparagine | Nmasn |
|  |  | L-N-methylaspartic acid | Nmasp |
| aminoisobutyric acid | Aib | L-N-methylcysteine | Nmcys |
| aminonorbornyl- | Norb | L-N-methylglutamine | Nmgln |

TABLE 1-continued

| Non-conventional amino acid | Code | Non-conventional amino acid | Code |
|---|---|---|---|
| Carboxylate | | L-N-methylglutamic acid | Nmglu |
| Cyclohexylalanine | Chexa | L-N-methylhistidine | Nmhis |
| Cyclopentylalanine | Cpen | L-N-methylisolleucine | Nmile |
| D-alanine | Dal | L-N-methylleucine | Nmleu |
| D-arginine | Darg | L-N-methyllysine | Nmlys |
| D-aspartic acid | Dasp | L-N-methylmethionine | Nmmet |
| D-cysteine | Dcys | L-N-methylnorleucine | Nmnle |
| D-glutamine | Dgln | L-N-methylnorvaline | Nmnva |
| D-glutamic acid | Dglu | L-N-methylornithine | Nmorn |
| D-histidine | Dhis | L-N-methylphenylalanine | Nmphe |
| D-isoleucine | Dile | L-N-methylproline | Nmpro |
| D-leucine | Dleu | L-N-methylserine | Nmser |
| D-lysine | Dlys | L-N-methylthreonine | Nmthr |
| D-methionine | Dmet | L-N-methyltryptophan | Nmtrp |
| D-ornithine | Dorn | L-N-methyltyrosine | Nmtyr |
| D-phenylalanine | Dphe | L-N-methylvaline | Nmval |
| D-proline | Dpro | L-N-methylethylglycine | Nmetg |
| D-serine | Dser | L-N-methyl-t-butylglycine | Nmtbug |
| D-threonine | Dthr | L-norleucine | Nle |
| D-tryptophan | Dtrp | L-norvaline | Nva |
| D-tyrosine | Dtyr | α-methyl-aminoisobutyrate | Maib |
| D-valine | Dval | α-methyl-γ-aminobutyrate | Mgabu |
| D-α-methylalanine | Dmala | α-methylcyclohexylalanine | Mchexa |
| D-α-methylarginine | Dmarg | α-methylcyclopentylalanine | Mcpen |
| D-α-methylasparagine | Dmasn | α-methyl-α-napthylalanine | Manap |
| D-α-methylaspartate | Dmasp | α-methylpenicillamine | Mpen |
| D-α-methylcysteine | Dmcys | N-(4-aminobutyl)glycine | Nglu |
| D-α-methylglutamine | Dmgln | N-(2-aminoethyl)glycine | Naeg |
| D-α-methylhistidine | Dmhis | N-(3-aminopropyl)glycine | Norn |
| D-α-methylisoleucine | Dmile | N-amino-α-methylbutyrate | Nmaabu |
| D-α-methylleucine | Dmleu | α-napthylalanine | Anap |
| D-α-methyllysine | Dmlys | N-benzylglycine | Nphe |
| D-α-methylmethionine | Dmmet | N-(2-carbamylethyl)glycine | Ngln |
| D-α-methylornithine | Dmorn | N-(carbamylmethyl)glycine | Nasn |
| D-α-methylphenylalanine | Dmphe | N-(2-carboxyethyl)glycine | Nglu |
| D-α-methylproline | Dmpro | N-(carboxymethyl)glycine | Nasp |
| D-α-methylserine | Dmser | N-cyclobutylglycine | Ncbut |
| D-α-methylthreonine | Dmthr | N-cycloheptylglycine | Nchep |
| D-α-methyltryptophan | Dmtrp | N-cyclohexylglycine | Nchex |
| D-α-methyltyrosine | Dmty | N-cyclodecylglycine | Ncdec |
| D-α-methylvaline | Dmval | N-cyclododeclglycine | Ncdod |
| D-α-methylalnine | Dnmala | N-cyclooctylglycine | Ncoct |
| D-α-methylarginine | Dnmarg | N-cyclopropylglycine | Ncpro |
| D-α-methylasparagine | Dnmasn | N-cycloundecylglycine | Ncund |
| D-α-methylasparatate | Dnmasp | N-(2,2-diphenylethyl)glycine | Nbhm |
| D-α-methylcysteine | Dnmcys | N-(3,3-diphenylpropyl)glycine | Nbhe |
| D-N-methylleucine | Dnmleu | N-(3-indolylyethyl) glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nva |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | Penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomo phenylalanine | Mhphe |
| L-α-methylisoleucine | Mile | N-(2-methylthioethyl)glycine | Nmet |
| D-N-methylglutamine | Dnmgln | N-(3-guanidinopropyl)glycine | Narg |
| D-N-methylglutamate | Dnmglu | N-(1-hydroxyethyl)glycine | Nthr |
| D-N-methylhistidine | Dnmhis | N-(hydroxyethyl)glycine | Nser |
| D-N-methylisoleucine | Dnmile | N-(imidazolylethyl)glycine | Nhis |
| D-N-methylleucine | Dnmleu | N-(3-indolylyethyl)glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |

TABLE 1-continued

| Non-conventional amino acid | Code | Non-conventional amino acid | Code |
|---|---|---|---|
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nval |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | Penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomophenylalanine | Mhphe |
| L-α-methylisoleucine | Mile | N-(2-methylthioethyl)glycine | Nmet |
| L-α-methylleucine | Mleu | L-α-methyllysine | Mlys |
| L-α-methylmethionine | Mmet | L-α-methylnorleucine | Mnle |
| L-α-methylnorvaline | Mnva | L-α-methylornithine | Morn |
| L-α-methylphenylalanine | Mphe | L-α-methylproline | Mpro |
| L-α-methylserine | mser | L-α-methylthreonine | Mthr |
| L-α-methylvaline | Mtrp | L-α-methyltyrosine | Mtyr |
| L-α-methylleucine | Mval | L-N-methylhomophenylalanine | Nmhphe |
|  | Nnbhm |  |  |
| N-(N-(2,2-diphenylethyl) carbamylmethyl-glycine | Nnbhm | N-(N-(3,3-diphenylpropyl) carbamylmethyl(1)glycine | Nnbhe |
| 1-carboxy-1-(2,2-diphenylethylamino) cyclopropane | Nmbc |  |  |

Since the peptides of the present invention are preferably utilized in diagnostics which require the peptides to be in soluble form, the peptides of the present invention preferably include one or more non-natural or natural polar amino acids, including but not limited to serine and threonine which are capable of increasing peptide solubility due to their hydroxyl-containing side chain.

The peptides of the present invention are preferably utilized in a linear form, although it will be appreciated that in cases where cyclicization does not severely interfere with peptide characteristics, cyclic forms of the peptide can also be utilized.

The peptides of present invention can be biochemically synthesized such as by using standard solid phase techniques. These methods include exclusive solid phase synthesis well known in the art, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Synthetic peptides can be purified by preparative high performance liquid chromatography and the composition of which can be confirmed via amino acid sequencing.

In cases where large amounts of the peptides of the present invention are desired, the peptides of the present invention can be generated using recombinant techniques such as described by Bitter et al., (1987) Methods in Enzymol. 153:516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463 and also as described above.

Antibodies

"Antibody" refers to a polypeptide ligand that is preferably substantially encoded by an immunoglobulin gene or immunoglobulin genes, or fragments thereof, which specifically binds and recognizes an epitope (e.g., an antigen). The recognized immunoglobulin genes include the kappa and lambda light chain constant region genes, the alpha, gamma, delta, epsilon and mu heavy chain constant region genes, and the myriad-immunoglobulin variable region genes. Antibodies exist, e.g., as intact immunoglobulins or as a number of well characterized fragments produced by digestion with various peptidases. This includes, e.g., Fab' and F(ab)'$_2$ fragments. The term "antibody," as used herein, also includes antibody fragments either produced by the modification of whole antibodies or those synthesized de novo using recombinant DNA methodologies. It also includes polyclonal antibodies, monoclonal antibodies, chimeric antibodies, humanized antibodies, or single chain antibodies. "Fc" portion of an antibody refers to that portion of an immunoglobulin heavy chain that comprises one or more heavy chain constant region domains, CH1, CH2 and CH3, but does not include the heavy chain variable region.

The functional fragments of antibodies, such as Fab, F(ab')2, and Fv that are capable of binding to macrophages, are described as follows: (1) Fab, the fragment which contains a monovalent antigen-binding fragment of an antibody molecule, can be produced by digestion of whole antibody with the enzyme papain to yield an intact light chain and a portion of one heavy chain; (2) Fab', the fragment of an antibody molecule that can be obtained by treating whole antibody with pepsin, followed by reduction, to yield an intact light chain and a portion of the heavy chain; two Fab' fragments are obtained per antibody molecule; (3) (Fab')2, the fragment of the antibody that can be obtained by treating whole antibody with the enzyme pepsin without subsequent reduction; F(ab')2 is a dimer of two Fab' fragments held together by two disulfide bonds; (4) Fv, defined as a genetically engineered fragment containing the variable region of the light chain and the variable region of the heavy chain expressed as two chains; and (5) Single chain antibody ("SCA"), a genetically engineered molecule containing the variable region of the light chain and the variable region of the heavy chain, linked by a suitable polypeptide linker as a genetically fused single chain molecule.

Methods of producing polyclonal and monoclonal antibodies as well as fragments thereof are well known in the art (See for example, Harlow and Lane, Antibodies: A Laboratory Manual, Cold Spring Harbor Laboratory, New York, 1988, incorporated herein by reference).

Antibody fragments according to the present invention can be prepared by proteolytic hydrolysis of the antibody or by expression in E. coli or mammalian cells (e.g. Chinese hamster ovary cell culture or other protein expression systems) of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')2. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using pepsin produces two monovalent Fab' fragments and an Fc fragment directly. These methods are described, for example, by Goldenberg, U.S. Pat. Nos. 4,036,945 and 4,331,647, and references contained therein, which patents are hereby incorporated by reference in their entirety. See also Porter, R. R. [Biochem. J. 73: 119-126 (1959)]. Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

Fv fragments comprise an association of VH and VL chains. This association may be noncovalent, as described in Inbar et al. [Proc. Nat'l Acad. Sci. USA 69:2659-62 (19720]. Alternatively, the variable chains can be linked by an intermolecular disulfide bond or crosslinked by chemicals such as glutaraldehyde. Preferably, the Fv fragments comprise VH and VL chains connected by a peptide linker. These single-chain antigen binding proteins (sFv) are prepared by constructing a structural gene comprising DNA sequences encoding the VH and VL domains connected by an oligonucleotide. The structural gene is inserted into an expression vector, which is subsequently introduced into a host cell such as E. coli. The recombinant host cells synthesize a single polypeptide chain with a linker peptide bridging the two V domains. Methods for producing sFvs are described, for example, by [Whitlow and Filpula, Methods 2: 97-105 (1991); Bird et al., Science 242:423-426 (1988); Pack et al., Bio/Technology 11:1271-77 (1993); and U.S. Pat. No. 4,946,778, which is hereby incorporated by reference in its entirety.

Another form of an antibody fragment is a peptide coding for a single complementarity-determining region (CDR). CDR peptides ("minimal recognition units") can be obtained by constructing genes encoding the CDR of an antibody of interest. Such genes are prepared, for example, by using the polymerase chain reaction to synthesize the variable region from RNA of antibody-producing cells. See, for example, Larrick and Fry [Methods, 2: 106-10 (1991)].

Humanized forms of non-human (e.g., murine) antibodies are chimeric molecules of immunoglobulins, immunoglobulin chains or fragments thereof (such as Fv, Fab, Fab', F(ab') or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., Nature, 321:522-525 (1986); Riechmann et al., Nature, 332:323-329 (1988); and Presta, Curr. Op. Struct. Biol., 2:593-596 (1992)].

Methods for humanizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers [Jones et al., Nature, 321:522-525 (1986); Riechmann et al., Nature 332:323-327 (1988); Verhoeyen et al., Science, 239:1534-1536 (1988)], by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boerner et al. are also available for the preparation of human monoclonal antibodies (Cole et al., Monoclonal Antibodies and Cancer Therapy, Alan R. Liss, p. 77 (1985) and Boerner et al., J. Immunol., 147(1):86-95 (1991)]. Similarly, human antibodies can be made by introduction of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633, 425; 5,661,016, and in the following scientific publications: Marks et al., Bio/Technology 10: 779-783 (1992); Lonberg et al., Nature 368: 856-859 (1994); Morrison, Nature 368 812-13 (1994); Fishwild et al., Nature Biotechnology 14, 845-51 (1996); Neuberger, Nature Biotechnology 14: 826 (1996); and Lonberg and Huszar, Intern. Rev. Immunol. 13, 65-93 (1995).

Preferably, the antibody of this aspect of the present invention specifically binds at least one epitope of the polypeptide variants of the present invention. As used herein, the term "epitope" refers to any antigenic determinant on an antigen to which the paratope of an antibody binds.

Epitopic determinants usually consist of chemically active surface groupings of molecules such as amino acids or carbohydrate side chains and usually have specific three dimensional structural characteristics, as well as specific charge characteristics.

Optionally, a unique epitope may be created in a variant due to a change in one or more post-translational modifications, including but not limited to glycosylation and/or phosphorylation, as described below. Such a change may also cause a new epitope to be created, for example through removal of glycosylation at a particular site.

An epitope according to the present invention may also optionally comprise part or all of a unique sequence portion of a variant according to the present invention in combination with at least one other portion of the variant which is not contiguous to the unique sequence portion in the linear polypeptide itself, yet which are able to form an epitope in combination. One or more unique sequence portions may optionally combine with one or more other non-contiguous portions of the variant (including a portion which may have high homology to a portion of the known protein) to form an epitope.

Immunoassays

In another embodiment of the present invention, an immunoassay can be used to qualitatively or quantitatively detect and analyze markers in a sample. This method comprises: providing an antibody that specifically binds to a marker; contacting a sample with the antibody; and detecting the presence of a complex of the antibody bound to the marker in the sample.

To prepare an antibody that specifically binds to a marker, purified protein markers can be used. Antibodies that specifically bind to a protein marker can be prepared using any suitable methods known in the art.

After the antibody is provided, a marker can be detected and/or quantified using any of a number of well recognized immunological binding assays. Useful assays include, for example, an enzyme immune assay (EIA) such as enzyme-linked immunosorbent assay (ELISA), a radioimmune assay (RIA), a Western blot assay, or a slot blot assay see, e.g., U.S. Pat. Nos. 4,366,241; 4,376,110; 4,517,288; and 4,837,168). Generally, a sample obtained from a subject can be contacted with the antibody that specifically binds the marker.

Optionally, the antibody can be fixed to a solid support to facilitate washing and subsequent isolation of the complex, prior to contacting the antibody with a sample. Examples of solid supports include but are not limited to glass or plastic in the form of, e.g., a microtiter plate, a stick, a bead, or a microbead. Antibodies can also be attached to a solid support.

After incubating the sample with antibodies, the mixture is washed and the antibody-marker complex formed can be detected. This can be accomplished by incubating the washed mixture with a detection reagent. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

Throughout the assays, incubation and/or washing steps may be required after each combination of reagents. Incubation steps can vary from about 5 seconds to several hours, preferably from about 5 minutes to about 24 hours. However, the incubation time will depend upon the assay format, marker, volume of solution, concentrations and the like. Usually the assays will be carried out at ambient temperature, although they can be conducted over a range of temperatures, such as 10° C. to 40° C.

The immunoassay can be used to determine a test amount of a marker in a sample from a subject. First, a test amount of a marker in a sample can be detected using the immunoassay methods described above. If a marker is present in the sample, it will form an antibody-marker complex with an antibody that specifically binds the marker under suitable incubation conditions described above. The amount of an antibody-marker complex can optionally be determined by comparing to a standard. As noted above, the test amount of marker need not be measured in absolute units, as long as the unit of measurement can be compared to a control amount and/or signal.

Preferably used are antibodies which specifically interact with the polypeptides of the present invention and not with wild type proteins or other isoforms thereof, for example. Such antibodies are directed, for example, to the unique sequence portions of the polypeptide variants of the present invention, including but not limited to bridges, heads, tails and insertions described in greater detail below. Preferred embodiments of antibodies according to the present invention are described in greater detail with regard to the section entitled "Antibodies".

Radio-immunoassay (RIA): In one version, this method involves precipitation of the desired substrate and in the methods detailed hereinbelow, with a specific antibody and radiolabelled antibody binding protein (e.g., protein A labeled with $I^{125}$) immobilized on a precipitable carrier such as agarose beads. The number of counts in the precipitated pellet is proportional to the amount of substrate.

In an alternate version of the RIA, a labeled substrate and an unlabelled antibody binding protein are employed. A sample containing an unknown amount of substrate is added in varying amounts. The decrease in precipitated counts from the labeled substrate is proportional to the amount of substrate in the added sample.

Enzyme linked immunosorbent assay (ELISA): This method involves fixation of a sample (e.g., fixed cells or a proteinaceous solution) containing a protein substrate to a surface such as a well of a microtiter plate. A substrate specific antibody coupled to an enzyme is applied and allowed to bind to the substrate. Presence of the antibody is then detected and quantitated by a colorimetric reaction employing the enzyme coupled to the antibody. Enzymes commonly employed in this method include horseradish peroxidase and alkaline phosphatase. If well calibrated and within the linear range of response, the amount of substrate present in the sample is proportional to the amount of color produced. A substrate standard is generally employed to improve quantitative accuracy.

Western blot: This method involves separation of a substrate from other protein by means of an acrylamide gel followed by transfer of the substrate to a membrane (e.g., nylon or PVDF). Presence of the substrate is then detected by antibodies specific to the substrate, which are in turn detected by antibody binding reagents. Antibody binding reagents may be, for example, protein A, or other antibodies. Antibody binding reagents may be radiolabelled or enzyme linked as described hereinabove. Detection may be by autoradiography, calorimetric reaction or chemiluminescence. This method allows both quantitation of an amount of substrate and determination of its identity by a relative position on the membrane which is indicative of a migration distance in the acrylamide gel during electrophoresis.

Immunohistochemical analysis: This method involves detection of a substrate in situ in fixed cells by substrate specific antibodies. The substrate specific antibodies may be enzyme linked or linked to fluorophores. Detection is by microscopy and subjective evaluation. If enzyme linked antibodies are employed, a calorimetric reaction may be required.

Fluorescence activated cell sorting (FACS): This method involves detection of a substrate in situ in cells by substrate specific antibodies. The substrate specific antibodies are linked to fluorophores. Detection is by means of a cell sorting machine which reads the wavelength of light emitted from each cell as it passes through a light beam. This method may employ two or more antibodies simultaneously.

Radio-imaging Methods

These methods include but are not limited to, positron emission tomography (PET) single photon emission computed tomography (SPECT). Both of these techniques are noninvasive, and can be used to detect and/or measure a wide variety of tissue events and/or functions, such as detecting cancerous cells for example. Unlike PET, SPECT can optionally be used with two labels simultaneously. SPECT has some other advantages as well, for example with regard to cost and the types of labels that can be used. For example, U.S. Pat. No. 6,696,686 describes the use of SPECT for detection of breast cancer, and is hereby incorporated by reference as if fully set forth herein.

Display Libraries

According to still another aspect of the present invention there is provided a display library comprising a plurality of display vehicles (such as phages, viruses or bacteria) each displaying at least 6, at least 7, at least 8, at least 9, at least 10, 10-15, 12-17, 15-20, 15-30 or 20-50 consecutive amino acids derived from the polypeptide sequences of the present invention.

Methods of constructing such display libraries are well known in the art. Such methods are described in, for example, Young A C, et al., "The three-dimensional structures of a polysaccharide binding antibody to *Cryptococcus neoformans* and its complex with a peptide from a phage display library: implications for the identification of peptide mimotopes" J Mol Biol 1997 Dec. 12; 274(4):622-34; Giebel L B et al. "Screening of cyclic peptide phage libraries identifies ligands that bind streptavidin with high affinities" Biochemistry 1995 Nov. 28; 34(47):15430-5; Davies E L et al., "Selection of specific phage-display antibodies using libraries derived from chicken immunoglobulin genes" J Immunol Methods 1995 Oct. 12; 186(1):125-35; Jones C R T al. "Current trends in molecular recognition and bioseparation" J Chromatogr A 1995 Jul. 14; 707(1):3-22; Deng S J et al. "Basis for selection of improved carbohydrate-binding single-chain antibodies from synthetic gene libraries" Proc Natl Acad Sci USA 1995 May 23; 92(11):4992-6; and Deng S J et al. "Selection of antibody single-chain variable fragments with improved carbohydrate binding by phage display" J Biol Chem 1994 Apr. 1; 269(13):9533-8, which are incorporated herein by reference.

The following sections relate to Candidate Marker Examples (first section) and to Experimental Data for these Marker Examples (second section). It should be noted that Table numbering is restarted within each section.

Candidate Marker Examples Section

This section relates to examples of sequences according to the present invention, including illustrative methods of selection thereof.

Description of the Methodology Undertaken to Uncover the Biomolecular Sequences of the Present Invention Human ESTs and cDNAs were obtained from GenBank versions 136 (Jun. 15, 2003 ftp dot ncbi dot nih dot gov/genbank/release dot notes/gb136 dot release dot notes); NCBI genome assembly of April 2003; RefSeq sequences from June 2003; Genbank version 139 (December 2003); Human Genome from NCBI (Build 34) (from October 2003); and RefSeq sequences from December 2003 dot With regard to GenBank sequences, the human EST sequences from the EST (GBEST) section and the human mRNA sequences from the primate (GBPRI) section were used; also the human nucleotide RefSeq mRNA sequences were used (see for example dot ncbi dot nlm dot nih dot gov/Genbank/GenbankOverview dot html and for a reference to the EST section, see dot ncbi dot nlm dot nih dot gov/dbEST/; a general reference to dbEST, the EST database in GenBank, may be found in Boguski et al, Nat Genet. 1993 August; 4(4):332-3; all of which are hereby incorporated by reference as if fully set forth herein).

Novel splice variants were predicted using the LEADS clustering and assembly system as described in Sorek, R., Ast, G. & Graur, D. Alu-containing exons are alternatively spliced. Genome Res 12, 1060-7 (2002); U.S. Pat. No. 6,625,545; and U.S. patent application Ser. No. 10/426,002, published as US20040101876 on May 27, 2004; all of which are hereby incorporated by reference as if fully set forth herein. Briefly, the software cleans the expressed sequences from repeats, vectors and immunoglobulins. It then aligns the expressed sequences to the genome taking alternatively splicing into account and clusters overlapping expressed sequences into "clusters" that represent genes or partial genes.

These were annotated using the GeneCarta (Compugen, Tel-Aviv, Israel) platform. The GeneCarta platform includes a rich pool of annotations, sequence information (particularly of spliced sequences), chromosomal information, alignments, and additional information such as SNPs, gene ontology terms, expression profiles, functional analyses, detailed domain structures, known and predicted proteins and detailed homology reports.

A brief explanation is provided with regard to the method of selecting the candidates. However, it should be noted that this explanation is provided for descriptive purposes only, and is not intended to be limiting in any way. The potential markers were identified by a computational process that was designed to find genes and/or their splice variants that are specifically expressed in cardiac tissue, as opposed to other types of tissues and also particularly as opposed to muscle tissue, by using databases of expressed sequences. Various parameters related to the information in the EST libraries, determined according to classification by library annotation, were used to assist in locating genes and/or splice variants thereof that are specifically and/or differentially expressed in heart tissues. The detailed description of the selection method and of these parameters is presented in Example 1 below.

EXAMPLE 1

Identification of Differentially Expressed Gene Products—Algorithm

In order to distinguish between differentially expressed gene products and constitutively expressed genes (i.e., house keeping genes), an algorithm based on an analysis of frequencies was configured. A specific algorithm for identification of transcripts specifically expressed in heart tissue is described hereinbelow.

EST Analysis

ESTs were taken from the following main sources: libraries contained in Genbank version 136 (Jun. 15, 2003 ftp-.ncbi.nih.gov/genbank/release.notes/gb136.release.notes) and Genbank version 139 (December 2003); and from the LifeSeq library of Incyte Corporation (ESTs only; Wilmington, Del., USA). With regard to GenBank sequences, the human EST sequences from the EST (GBEST) section were used.

Library annotation—EST libraries were manually classified according to:
1. Tissue origin
2. Biological source—Examples of frequently used biological sources for construction of EST libraries include cancer cell-lines; normal tissues; cancer tissues; foetal tissues; and others such as normal cell lines and pools of normal cell-lines, cancer cell-lines and combinations thereof. A specific description of abbreviations used below with regard to these tissues/cell lines etc is given above.
3. Protocol of library construction—various methods are known in the art for library construction including normalized library construction; non-normalized library construction; subtracted libraries; ORESTES and others (described in the annotation available in Genbank). It will be appreciated that at times the protocol of library construction is not indicated in the information available about that library.

The following rules were followed:

EST libraries originating from identical biological samples were considered as a single library.

EST libraries which included above-average levels of contamination, such as DNA contamination for example, were eliminated. The presence of such contamination was determined as follows. For each library, the number of unspliced ESTs that are not fully contained within other spliced sequences was counted. If the percentage of such sequences (as compared to all other sequences) was at least 4 standard deviations above the average for all libraries being analyzed, this library was tagged as being contaminated and was eliminated from further consideration in the below analysis (see also Sorek, R. & Safer, H. M. A novel algorithm for computational identification of contaminated EST libraries. Nucleic Acids Res 31, 1067-74 (2003) for further details).

Clusters (genes) having at least five sequences including at least two sequences from the tissue of interest were analyzed. Splice variants were identified by using the LEADS software package as described above.

EXAMPLE 2

Identification of Heart Tissue Specific Genes

For detection of heart tissue specific clusters, heart tissue libraries/sequences were compared to the total number of libraries/sequences in the cluster and in Genebank, and to the relevant numbers for muscle tissue libraries/sequences. Statistical tools were employed to identify clusters that were heart tissue specific, both as compared to all other tissues and also in comparison to muscle tissue.

The algorithm—for each tested tissue T and for each tested cluster the following were examined:

1. Each cluster includes at least 2 libraries from the tissue T. At least 3 clones (weighed—as described above) from tissue T in the cluster;

2. The following equation was then used to determine heart tissue-specific expression as compared to expression in all tissue types for a particular cluster:

$$\frac{t}{T} / \frac{n-t-m}{N-T-M}$$

in which n is the total number of ESTs available for a cluster, while N is the total number of ESTs available in all of the libraries considered in the analysis (effectively all ESTs in Genbank, except for those that were rejected as belonging to contaminated libraries). This ratio was preferably set to be at least about 8, although optionally the ratio could be set to be at least about 5.

3. The following equation was then used to determine heart tissue-specific expression vs. expression in skeletal muscle tissue for a particular cluster:

$$\frac{t}{T} / \frac{m}{M}$$

in which t represents the number of heart tissue-specific ESTs for the cluster, while T is the number of all heart tissue-specific ESTs in the analysis; m is the number of skeletal muscle tissue-specific ESTs for the cluster, while M is the number of all skeletal muscle tissue-specific ESTs in the analysis. This ratio was preferably set to be at least about 4, although optionally the ratio could be set to be at least about 2.

4. Fisher exact test P-values were computed for weighted clone counts to check that the counts are statistically significant according to the following function: $F(t,T,n,N)$ which is the probability of a cluster actually being overexpressed in heart tissue, as compared to its overall level of expression. The P-value was preferably set to be less than about 1e−5, although optionally it could be set to be less than about 1e−3.

The results obtained are explained in greater detail for each marker below.

Actual Marker Examples

The following examples relate to specific actual marker examples. It should be noted that Table numbering is restarted within each example related to a particular Cluster, as indicated by the titles below.

EXAMPLES SECTION

This Section relates to Examples of sequences according to the present invention, including experiments involving these sequences, and illustrative, non-limiting examples of methods, assays and uses thereof. The materials and experimental procedures are explained first, as all experiments used them as a basis for the work that was performed.

The markers of the present invention were tested with regard to their expression in various heart and non-heart tissue samples. Unless otherwise noted, all experimental data relates to variants of the present invention, named according to the segment being tested (as expression was tested through RT-PCR as described). A description of the samples used in the panel is provided in Table 1 below. Tests were then performed as described in the Examples below.

TABLE 1

Tissue samples in testing panel

|  | Lot no. | Source | Tissue | Pathology | Sex/Age |
|---|---|---|---|---|---|
| 1-Am-Colon (C71) | 071P10B | Ambion | Colon | PM | F/43 |
| 2-B-Colon (C69) | A411078 | Biochain | Colon | PM-Pool of 10 | M&F |
| 3-Cl-Colon (C70) | 1110101 | Clontech | Colon | PM-Pool of 3 | M&F |
| 4-Am-Small Intestine | 091P0201A | Ambion | Small Intestine | PM | M/75 |
| 5-B-Small Intestine | A501158 | Biochain | Small Intestine | PM | M/63 |
| 6-B-Rectum | A605138 | Biochain | Rectum | PM | M/25 |
| 7-B-Rectum | A610297 | Biochain | Rectum | PM | M/24 |
| 8-B-Rectum | A610298 | Biochain | Rectum | PM | M/27 |
| 9-Am-Stomach | 110P04A | Ambion | Stomach | PM | M/16 |
| 10-B-Stomach | A501159 | Biochain | Stomach | PM | M/24 |
| 11-B-Esophagus | A603814 | Biochain | Esophagus | PM | M/26 |
| 12-B-Esophagus | A603813 | Biochain | Esophagus | PM | M/41 |
| 13-Am-Pancreas | 071P25C | Ambion | Pancreas | PM | M/25 |
| 14-CG-Pancreas | CG-255-2 | Ichilov | Pancreas | PM | M/75 |
| 15-B-Lung | A409363 | Biochain | Lung | PM | F/26 |
| 16-Am-Lung (L93) | 111P0103A | Ambion | Lung | PM | F/61 |
| 17-B-Lung (L92) | A503204 | Biochain | Lung | PM | M/28 |
| 18-Am-Ovary (O47) | 061P43A | Ambion | Ovary | PM | F/16 |
| 19-B-Ovary (O48) | A504087 | Biochain | Ovary | PM | F/51 |
| 20-B-Ovary (O46) | A504086 | Biochain | Ovary | PM | F/41 |
| 21-Am-Cervix | 101P0101A | Ambion | Cervix | PM | F/40 |
| 22-B-Cervix | A408211 | Biochain | Cervix | PM | F/36 |
| 23-B-Cervix | A504089 | Biochain | Cervix | PM-Pool of 5 | M&F |
| 24-B-Uterus | A411074 | Biochain | Uterus | PM-Pool of 10 | M&F |
| 25-B-Uterus | A409248 | Biochain | Uterus | PM | F/43 |
| 26-B-Uterus | A504090 | Biochain | Uterus | PM-Pool of 5 | M&F |
| 27-B-Bladder | A501157 | Biochain | Bladder | PM | M/29 |
| 28-Am-Bladder | 071P02C | Ambion | Bladder | PM | M/20 |
| 29-B-Bladder | A504088 | Biochain | Bladder | PM-Pool of 5 | M&F |
| 30-Am-Placenta | 021P33A | Ambion | Placenta | PB | F/33 |
| 31-B-Placenta | A410165 | Biochain | Placenta | PB | F/26 |
| 32-B-Placenta | A411073 | Biochain | Placenta | PB-Pool of 5 | M&F |
| 33-B-Breast (B59) | A607155 | Biochain | Breast | PM | F/36 |
| 34-Am-Breast (B63) | 26486 | Ambion | Breast | PM | F/43 |
| 35-Am-Breast (B64) | 23036 | Ambion | Breast | PM | F/57 |
| 36-Cl-Prostate (P53) | 1070317 | Clontech | Prostate | PB-Pool of 47 | M&F |
| 37-Am-Prostate (P42) | 061P04A | Ambion | Prostate | PM | M/47 |
| 38-Am-Prostate (P59) | 25955 | Ambion | Prostate | PM | M/62 |
| 39-Am-Testis | 111P0104A | Ambion | Testis | PM | M/25 |
| 40-B-Testis | A411147 | Biochain | Testis | PM | M/74 |
| 41-Cl-Testis | 1110320 | Clontech | Testis | PB-Pool of 45 | M&F |
| 42-CG-Adrenal | CG-184-10 | Ichilov | Adrenal | PM | F/81 |
| 43-B-Adrenal | A610374 | Biochain | Adrenal | PM | F/83 |
| 44-B-Heart | A411077 | Biochain | Heart | PB-Pool of 5 | M&F |
| 45-CG-Heart | CG-255-9 | Ichilov | Heart | PM | M/75 |
| 46-CG-Heart | CG-227-1 | Ichilov | Heart | PM | F/36 |
| 47-Am-Liver | 081P0101A | Ambion | Liver | PM | M/64 |
| 48-CG-Liver | CG-93-3 | Ichilov | Liver | PM | F/19 |
| 49-CG-Liver | CG-124-4 | Ichilov | Liver | PM | F/34 |
| 50-Cl-BM | 1110932 | Clontech | Bone Marrow | PM-Pool of 8 | M&F |
| 51-CGEN-Blood | WBC#5 | CGEN | Blood |  | M |
| 52-CGEN-Blood | WBC#4 | CGEN | Blood |  | M |
| 53-CGEN-Blood | WBC#3 | CGEN | Blood |  | M |
| 54-CG-Spleen | CG-267 | Ichilov | Spleen | PM | F/25 |
| 55-CG-Spleen | 111P0106B | Ambion | Spleen | PM | M/25 |
| 56-CG-Spleen | A409246 | Biochain | Spleen | PM | F/12 |
| 56-CG-Thymus | CG-98-7 | Ichilov | Thymus | PM | F/28 |
| 58-Am-Thymus | 101P0101A | Ambion | Thymus | PM | M/14 |
| 59-B-Thymus | A409278 | Biochain | Thymus | PM | M/28 |
| 60-B-Thyroid | A610287 | Biochain | Thyroid | PM | M/27 |
| 61-B-Thyroid | A610286 | Biochain | Thyroid | PM | M/24 |
| 62-CG-Thyroid | CG-119-2 | Ichilov | Thyroid | PM | F/66 |
| 63-Cl-Salivary Gland | 1070319 | Clontech | Salivary Gland | PM-Pool of 24 | M&F |
| 64-Am-Kidney | 111P0101B | Ambion | Kidney | PM-Pool of 14 | M&F |

TABLE 1-continued

Tissue samples in testing panel

| | Lot no. | Source | Tissue | Pathology | Sex/Age |
|---|---|---|---|---|---|
| 65-Cl-Kidney | 1110970 | Clontech | Kidney | PM-Pool of 14 | M&F |
| 66-B-Kidney | A411080 | Biochain | Kidney | PM-Pool of 5 | M&F |
| 67-CG-Cerebellum | CG-183-5 | Ichilov | Cerebellum | PM | M/74 |
| 68-CG-Cerebellum | CG-212-5 | Ichilov | Cerebellum | PM | M/54 |
| 69-B-Brain | A411322 | Biochain | Brain | PM | M/28 |
| 70-Cl-Brain | 1120022 | Clontech | Brain | PM-Pool of 2 | M&F |
| 71-B-Brain | A411079 | Biochain | Brain | PM-Pool of 2 | M&F |
| 72-CG-Brain | CG-151-1 | Ichilov | Brain | PM | F/86 |
| 73-Am-Skeletal Muscle | 101P013A | Ambion | Skeletal Muscle | PM | F/28 |
| 74-Cl-Skeletal Muscle | 1061038 | Clontech | Skeletal Muscle | PM-Pool of 2 | M&F |

Materials and Experimental Procedures

RNA preparation—RNA was obtained from Clontech (Franklin Lakes, N.J. USA 07417, dot clontech dot com), BioChain Inst. Inc. (Hayward, Calif. 94545 USA dot biochain dot com), ABS (Wilmington, Del. 19801, USA, dot absbioreagents dot com) or Ambion (Austin, Tex. 78744 USA, dot ambion dot com). Alternatively, RNA was generated from tissue samples using TRI-Reagent (Molecular Research Center), according to Manufacturer's instructions. Tissue and RNA samples were obtained from patients or from postmortem. Total RNA samples were treated with DNaseI (Ambion) and purified using RNeasy columns (Qiagen).

RT PCR—Purified RNA (1 µg) was mixed with 150 ng Random Hexamer primers (Invitrogen) and 500 µM dNTP in a total volume of 15.6 µl. The mixture was incubated for 5 min at 65° C. and then quickly chilled on ice. Thereafter, 5 µl of 5× SuperscriptII first strand buffer (Invitrogen), 2.4 µl 0.1M DTT and 40 units RNasin (Promega) were added, and the mixture was incubated for 10 min at 25° C., followed by further incubation at 42° C. for 2 min. Then, 1 µl (200 units) of SuperscriptII (Invitrogen) was added and the reaction (final volume of 25 µl) was incubated for 50 min at 42° C. and then inactivated at 70° C. for 15 min. The resulting cDNA was diluted 1:20 in TE buffer (10 mM Tris pH=8, 1 mM EDTA pH=8).

Real-Time RT-PCR analysis—cDNA (5 µl), prepared as described above, was used as a template in Real-Time PCR reactions using the SYBR Green I assay (PE Applied Biosystem) with specific primers and UNG Enzyme (Eurogentech or ABI or Roche). The amplification was effected as follows: 50° C. for 2 min, 95° C. for 10 min, and then 40 cycles of 95° C. for 15 sec, followed by 60° C. for 1 min. Detection was performed by using the PE Applied Biosystem SDS 7000. The cycle in which the reactions achieved a threshold level (Ct) of fluorescence was registered and was used to calculate the relative transcript quantity in the RT reactions. The relative quantity was calculated using the equation $Q = \text{efficiency}^{-Ct}$. The efficiency of the PCR reaction was calculated from a standard curve, created by using serial dilutions of several reverse transcription (RT) reactions To minimize inherent differences in the RT reaction, the resulting relative quantities were normalized to the geometric mean of the relative quantities of several housekeeping (HSKP) genes. Schematic summary of quantitative real-time PCR analysis is presented in FIG. 1. As shown, the x-axis shows the cycle number. The $C_T$=Threshold Cycle point, which is the cycle that the amplification curve crosses the fluorescence threshold that was set in the experiment. This point is a calculated cycle number in which PCR products signal is above the background level (passive dye ROX) and still in the Geometric/Exponential phase (as shown, once the level of fluorescence crosses the measurement threshold, it has a geometrically increasing phase, during which measurements are most accurate, followed by a linear phase and a plateau phase; for quantitative measurements, the latter two phases do not provide accurate measurements). The y-axis shows the normalized reporter fluorescence. It should be noted that this type of analysis provides relative quantification.

The sequences of the housekeeping genes measured in all the examples on normal tissue samples panel were as follows:

```
RPL19 (GenBank Accession No. NM_000981 (SEQ ID NO:437)),

RPL19 Forward primer (SEQ ID NO:438): TGGCAAGAAGAAGGTCTGGTTAG

RPL19 Reverse primer (SEQ ID NO:439): TGATCAGCCCATCTTTGATGAG

RPL19-amplicon (SEQ ID NO:440): TGGCAAGAAGAAGGTCTGGTTAGACCCCAATGAGACCAATGAAATCGCCAATG
CCAACTCCCGTCAGCAGATCCGGAAGCTCATCAAAGATGGGCTGATCA TATA box (GenBank Accession No. NM_003194 (SEQ ID NO:441)), TATA box Forward primer (SEQ ID NO:442): CGGTTTGCTGCGGTAATCAT TATA box Reverse primer (SEQ ID NO:443): TTTCTTGCTGCCAGTCTGGAC TATA box-amplicon (SEQ ID NO:444): CGGTTTGCTGCGGTAATCATGAGGATAAGAGAGCCACGAACCACGGCACTG
ATTTTCAGTTCTGGGAAAATGGTGTGCACAGGAGCCAAGAGTGAAGAACAGTCCAGACTGGCAGCAAGAAA Ubiquitin (GenBank Accession No. BC000449 (SEQ ID NO:445))
```

```
Ubiquitin Forward primer (SEQ ID NO:446): ATTTGGGTCGCGGTTCTTG

Ubiquitin Reverse primer (SEQ ID NO:447): TGCCTTGACATTCTCGATGGT

Ubiquitin-amplicon (SEQ ID NO:448): ATTTGGGTCGCGGTTCTTGTTTGTGGATCGCTGTGATCGTCACTTGACAA
TGCAGATCTTCGTGAAGACTCTGACTGGTAAGACCATCACCCTCGAGGTTGAGCCCAGTGACACCATCGAGAATGTCAAGGCA SDHA (GenBank Accession No. NM_004168 (SEQ ID NO:449))

SDHA Forward primer (SEQ ID NO:450): TGGGAACAAGAGGGCATCTG

SDHA Reverse primer (SEQ ID NO:451): CCACCACTGCATCAAATTCATG

SDHA-amplicon (SEQ ID NO:452): TGGGAACAAGAGGGCATCTGCTAAAGTTTCAGATTCCATTTCTGCTCAGTATCCA
GTAGTGGATCATGAATTTGATGCAGTGGTGG
```

Description for Cluster S67314

Cluster S67314 features 4 transcript(s) and 8 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO |
|---|---|
| S67314_PEA_1_T4 | 1 |
| S67314_PEA_1_T5 | 2 |
| S67314_PEA_1_T6 | 3 |
| S67314_PEA_1_T7 | 4 |

TABLE 2

Segments of interest

| Segment Name | SEQ ID NO |
|---|---|
| S67314_PEA_1_node_0 | 65 |
| S67314_PEA_1_node_11 | 66 |
| S67314_PEA_1_node_13 | 67 |
| S67314_PEA_1_node_15 | 68 |
| S67314_PEA_1_node_17 | 69 |
| S67314_PEA_1_node_4 | 70 |
| S67314_PEA_1_node_10 | 71 |
| S67314_PEA_1_node_3 | 72 |

TABLE 3

Proteins of interest

| Protein Name | SEQ ID NO |
|---|---|
| S67314_PEA_1_P4 | 281 |
| S67314_PEA_1_P5 | 282 |
| S67314_PEA_1_P6 | 283 |
| S67314_PEA_1_P7 | 284 |

These sequences are variants of the known protein Fatty acid-binding protein, heart (SEQ ID NO:348) (SwissProt accession identifier FABH_HUMAN; known also according to the synonyms H-FABP; Muscle fatty acid-binding protein; M-FABP; Mammary-derived growth inhibitor; MDGI), referred to herein as the previously known protein.

Protein Fatty acid-binding protein, heart (SEQ ID NO:348) is known or believed to have the following function(s): FABP are thought to play a role in the intracellular transport of long-chain fatty acids and their acyl-CoA esters. The sequence for protein Fatty acid-binding protein, heart is given at the end of the application, as "Fatty acid-binding protein, heart amino acid sequence" (SEQ ID NO:348). Known polymorphisms for this sequence are as shown in Table 4.

TABLE 4

Amino acid mutations for Known Protein

| SNP position(s) on amino acid sequence | Comment |
|---|---|
| 1 | V -> A |
| 104 | L -> K |
| 124 | C -> S |
| 129 | E -> Q |

Protein Fatty acid-binding protein, heart (SEQ ID NO:348) localization is believed to be Cytoplasmic.

The following GO Annotation(s) apply to the previously known protein. The following annotation(s) were found: negative control of cell proliferation, which are annotation(s) related to Biological Process; and lipid binding, which are annotation(s) related to Molecular Function. The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

The heart-selective diagnostic marker prediction engine provided the following results with regard to cluster S67314. Predictions were made for selective expression of transcripts of this cluster in heart tissue, according to the previously described methods. The numbers on the y-axis of FIG. 2 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 2, concerning the number of heart-specific clones in libraries/sequences; as well as with regard to the histogram in FIGS. 3-4, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 13.8; the ratio of expression of the cluster in heart specific ESTs to the overall expression of the cluster in muscle-specific ESTs which was found to be 2.6; and fisher exact test P-values were computed both for library and weighted clone counts to check that the counts are statistically significant, and were found to be 1.10E−25.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 2.6, which clearly supports specific expression in heart tissue.

As noted above, cluster S67314 features 4 transcript(s), which were listed in Table 1 above. These transcript(s) encode for protein(s) which are variant(s) of protein Fatty acid-binding protein, heart (SEQ ID NO:348). A description of each variant protein according to the present invention is now provided.

Variant protein S67314_PEA_1_P4 (SEQ ID NO:281) according to the present invention has an amino acid sequence as given at the end of the application; it is encoded by transcript(s) S67314_PEA_1_T4 (SEQ ID NO:1). An alignment is given to the known protein (Fatty acid-binding protein, heart (SEQ ID NO:348)) at the end of the application. One or more alignments to one or more previously published protein sequences are given at the end of the application. A brief description of the relationship of the variant protein according to the present invention to each such aligned protein is as follows:

Comparison report between S67314_PEA_1_P4 (SEQ ID NO:281) and FABH_HUMAN (SEQ ID NO:348):

1. An isolated chimeric polypeptide encoding for S67314_PEA_1_P4 (SEQ ID NO:281), comprising a first amino acid sequence being at least 70%, optionally at least 80%, preferably at least 85%, more preferably at least 90% and most preferably at least 95% homologous to a polypeptide having the sequence MVDAFLGTWKLVDSKNFDDYMKSLGVGFATRQVASMTKPTTIIEKNGDILTLKTHSTF KNTEISFKLGVEFDETTADDRKVKSIVTLDGGKLVHLQKWDGQETTLVRELIDGKLIL corresponding to amino acids 1-116 of FABH_HUMAN (SEQ ID NO:348), which also corresponds to amino acids 1-116 of S67314_PEA_1_P4 (SEQ ID NO:281), and a second amino acid sequence being at least 70%, optionally at least 80%, preferably at least 85%, more preferably at least 90% and most preferably at least 95% homologous to a polypeptide having the sequence VRWATLELYLIGYYYCSFSQACSKKPSPPLRAVEAGTREWLWVRVVSGGNFLCSGFGL TQAGTQILPYRLHDCGQITFSKCNCKT-GINNTNLVGLLGSL (SEQ ID NO:396) corresponding to amino acids 117-215 of S67314_PEA_1_P4 (SEQ ID NO:281), wherein said first and second amino acid sequences are contiguous and in a sequential order.

2. An isolated polypeptide encoding for a tail of S67314_PEA_1_P4 (SEQ ID NO:281), comprising a polypeptide being at least 70%, optionally at least about 80%, preferably at least about 85%, more preferably at least about 90% and most preferably at least about 95% homologous to the sequence VRWATLELYLIGYYYCSFSQACSKKPSPPLRAVEAGTREWLWVRVVSGGNFLCSGFGL TQAGTQILPYRLHDCGQITFSKCNCKT-GINNTNLVGLLGSL (SEQ ID NO:396) in S67314_PEA_1_P4 (SEQ ID NO:281).

Comparison report between S67314_PEA_1_P4 (SEQ ID NO:281) and AAP35373 (SEQ ID NO:348):

1. An isolated chimeric polypeptide encoding for S67314_PEA_1_P4 (SEQ ID NO:281), comprising a first amino acid sequence being at least 90% homologous to MVDAFLGTWKLVDSKNFDDYMKSLGVGFATRQVASMTKPTTIIEKNGDILTLKTHSTF KNTEISFKLGVEFDETTADDRKVKSIVTLDGGKLVHLQKWDGQETTLVRELIDGKLIL corresponding to amino acids 1-116 of AAP35373 (SEQ ID NO:348), which also corresponds to amino acids 1-116 of S67314_PEA_1_P4 (SEQ ID NO:281), and a second amino acid sequence being at least 70%, optionally at least 80%, preferably at least 85%, more preferably at least 90% and most preferably at least 95% homologous to a polypeptide having the sequence VRWATLELYLIGYYYCSFSQACSKKPSPPLRAVEAGTREWLWVRVVSGGNFLCSGFGL TQAGTQILPYRLHDCGQITFSKCNCKT-GINNTNLVGLLGSL (SEQ ID NO:396) corresponding to amino acids 117-215 of S67314_PEA_1_P4 (SEQ ID NO:281), wherein said first and second amino acid sequences are contiguous and in a sequential order.

2. An isolated polypeptide encoding for a tail of S67314_PEA_1_P4 (SEQ ID NO:281), comprising a polypeptide being at least 70%, optionally at least about 80%, preferably at least about 85%, more preferably at least about 90% and most preferably at least about 95% homologous to the sequence VRWATLELYLIGYYYCSFSQACSKKPSPPLRAVEAGTREWLWVRVVSGGNFLCSGFGL TQAGTQILPYRLHDCGQITFSKCNCKT-GINNTNLVGLLGSL (SEQ ID NO:396) in S67314_PEA_1_P4 (SEQ ID NO:281).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein S67314_PEA_1_P4 (SEQ ID NO:281) also has the following non-silent SNPs (Single Nucleotide Polymorphisms) as listed in Table 5, (given according to their position(s) on the amino acid sequence, with the alternative amino acid(s) listed; the last column indicates whether the SNP is known or not; the presence of known SNPs in variant protein S67314_PEA_1_P4 (SEQ ID NO:281) sequence provides support for the deduced sequence of this variant protein according to the present invention).

TABLE 5

Amino acid mutations

| SNP position(s) on amino acid sequence | Alternative amino acid(s) | Previously known SNP? |
|---|---|---|
| 53 | K -> R | Yes |

Variant protein S67314_PEA_1_P4 (SEQ ID NO:281) is encoded by the following transcript(s): S67314_PEA_1_T4 (SEQ ID NO:1), for which the sequence(s) is/are given at the end of the application. The coding portion of transcript S67314_PEA_1_T4 (SEQ ID NO:1) is shown in bold; this coding portion starts at position 925 and ends at position 1569. The transcript also has the following SNPs as listed in Table 6 (given according to their position on the nucleotide sequence, with the alternative nucleic acid listed; the last column indicates whether the SNP is known or not; the presence of known SNPs in variant protein S67314_PEA_1_P4 (SEQ ID NO:281) sequence provides support for the deduced sequence of this variant protein according to the present invention).

TABLE 6

Nucleic acid SNPs

| SNP position on nucleotide sequence | Alternative nucleic acid | Previously known SNP? |
|---|---|---|
| 580 | T -> C | Yes |
| 1082 | A -> G | Yes |
| 1670 | A -> C | Yes |

Variant protein S67314_PEA_1_P5 (SEQ ID NO:282) according to the present invention has an amino acid sequence as given at the end of the application; it is encoded by transcript(s) S67314_PEA 1_T5 (SEQ ID NO:2). An alignment is given to the known protein (Fatty acid-binding protein, heart (SEQ ID NO:348)) at the end of the application. One or more alignments to one or more previously published protein sequences are given at the end of the application. A brief description of the relationship of the variant protein according to the present invention to each such aligned protein is as follows:

Comparison report between S67314_PEA_1_P5 (SEQ ID NO:282) and FABH_HUMAN (SEQ ID NO:348):

1. An isolated chimeric polypeptide encoding for S67314_PEA_1_P5 (SEQ ID NO:282), comprising a first amino acid sequence being at least 70%, optionally at least 80%, preferably at least 85%, more preferably at least 90% and most preferably at least 95% homologous to a polypeptide having the sequence MVDAFLGTWKLVDSKNFD-DYMKSLGVGFATRQVASMTKPTTI-IEKNGDILTLKTHSTF KNTEISFKLGVEFDETTADDRKVK-SIVTLDGGKLVHLQKWDGQETTLVRELIDGKLIL corresponding to amino acids 1-116 of FABH_HUMAN (SEQ ID NO:348), which also corresponds to amino acids 1-116 of S67314_PEA_1_P5 (SEQ ID NO:282), and a second amino acid sequence being at least 70%, optionally at least 80%, preferably at least 85%, more preferably at least 90% and most preferably at least 95% homologous to a polypeptide having the sequence DVLTAWPSIYRRQVKVLRE-DEITILPWHLQWSREKATKLL-RPTLPSYNNHGWEELRVG KSIV (SEQ ID NO:397) corresponding to amino acids 117-178 of S67314_PEA_1_P5 (SEQ ID NO:282), wherein said first and second amino acid sequences are contiguous and in a sequential order.

2. An isolated polypeptide encoding for a tail of S67314_PEA_1_P5 (SEQ ID NO:282), comprising a polypeptide being at least 70%, optionally at least about 80%, preferably at least about 85%, more preferably at least about 90% and most preferably at least about 95% homologous to the sequence DVLTAWPSIYRRQVKVLREDEI-TILPWHLQWSREKATKLLRPTLPSYNNHGWEELRVG KSIV (SEQ ID NO:397) in S67314_PEA_1_P5 (SEQ ID NO:282).

Comparison report between S67314_PEA_1_P5 (SEQ ID NO:282) and AAP35373 (SEQ ID NO:348):

1. An isolated chimeric polypeptide encoding for S67314_PEA_1_P5 (SEQ ID NO:282), comprising a first amino acid sequence being at least 90% homologous to MVDAFLGTWKLVDSKNFDDYMKSLGVG-FATRQVASMTKPTTIIEKNGDILTLKTHSTF KNTEIS-FKLGVEFDETTADDRKVKSIVTLDG-GKLVHLQKWDGQETTLVRELIDGKLIL corresponding to amino acids 1-116 of AAP35373 (SEQ ID NO:348), which also corresponds to amino acids 1-116 of S67314_PEA_1_P5 (SEQ ID NO:282), and a second amino acid sequence being at least 70%, optionally at least 80%, preferably at least 85%, more preferably at least 90% and most preferably at least 95% homologous to a polypeptide having the sequence DVLTAWPSIYRRQVKVLREDEI-TILPWHLQWSREKATKLLRPTLPSYNNHGWEELRVG KSIV (SEQ ID NO:397) corresponding to amino acids 117-178 of S67314_PEA_1_P5 (SEQ ID NO:282), wherein said first and second amino acid sequences are contiguous and in a sequential order.

2. An isolated polypeptide encoding for a tail of S67314_PEA_1_P5 (SEQ ID NO:282), comprising a polypeptide being at least 70%, optionally at least about 80%, preferably at least about 85%, more preferably at least about 90% and most preferably at least about 95% homologous to the sequence DVLTAWPSIYRRQVKVLREDEI-TILPWHLQWSREKATKLLRPTLPSYNNHGWEELRVG KSIV (SEQ ID NO:397) in S67314_PEA_1_P5 (SEQ ID NO:282).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein S67314_PEA_1_P5 (SEQ ID NO:282) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein S67314_PEA_1_P5 (SEQ ID NO:282) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 53 | K -> R | Yes |

Variant protein S67314_PEA_1_P5 (SEQ ID NO:282) is encoded by the following transcript(s): S67314_PEA_1_T5 (SEQ ID NO:2), for which the sequence(s) is/are given at the end of the application. The coding portion of transcript S67314_PEA_1_T5 (SEQ ID NO:2) is shown in bold; this coding portion starts at position 925 and ends at position 1458. The transcript also has the following SNPs as listed in Table 8 (given according to their position on the nucleotide sequence, with the alternative nucleic acid listed; the last column indicates whether the SNP is known or not; the presence of known SNPs in variant protein S67314_PEA_1_P5 (SEQ ID NO:282) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 580 | T -> C | Yes |
| 1082 | A -> G | Yes |
| 1326 | A -> G | Yes |

Variant protein S67314_PEA_1_P6 (SEQ ID NO:283) according to the present invention has an amino acid sequence as given at the end of the application; it is encoded by transcript(s) S67314_PEA_1_T6 (SEQ ID NO:3). An alignment is given to the known protein (Fatty acid-binding protein, heart (SEQ ID NO:348)) at the end of the application. One or more alignments to one or more previously published protein sequences are given at the end of the application. A brief description of the relationship of the variant protein according to the present invention to each such aligned protein is as follows:

Comparison report between S67314_PEA_1_P6 (SEQ ID NO:283) and FABH_HUMAN (SEQ ID NO:348):

1. An isolated chimeric polypeptide encoding for S67314_PEA_1_P6 (SEQ ID NO:283), comprising a first amino acid sequence being at least 70%, optionally at least 80%, preferably at least 85%, more preferably at least 90% and most preferably at least 95% homologous to a polypeptide having the sequence MVDAFLGTWKLVDSKNFD-DYMKSLGVGFATRQVASMTKPTTI-IEKNGDILTLKTHSTF KNTEISFKLGVEFDETTADDRKVK-SIVTLDGGKLVHLQKWDGQETTLVRELIDGKLIL corresponding to amino acids 1-116 of FABH_HUMAN (SEQ ID NO:348), which also corresponds to amino acids 1-116 of S67314_PEA_1_P6 (SEQ ID NO:283), and a second amino acid sequence being at least 70%, optionally at least 80%, preferably at least 85%, more preferably at least 90% and most preferably at least 95% homologous to a polypeptide having the sequence MEKLQLRNVK (SEQ ID NO:398) corresponding to amino acids 117-126 of S67314_PEA_1_P6 (SEQ ID NO:283), wherein said first and second amino acid sequences are contiguous and in a sequential order.

2. An isolated polypeptide encoding for a tail of S67314_PEA_1_P6 (SEQ ID NO:283), comprising a polypeptide being at least 70%, optionally at least about 80%, preferably at least about 85%, more preferably at least about 90% and most preferably at least about 95% homologous to the sequence MEKLQLRNVK (SEQ ID NO:398) in S67314_PEA_1_P6 (SEQ ID NO:283).

Comparison report between S67314_PEA_1_P6 (SEQ ID NO:283) and AAP35373 (SEQ ID NO:348):

1. An isolated chimeric polypeptide encoding for S67314_PEA_1_P6 (SEQ ID NO:283), comprising a first amino acid sequence being at least 90% homologous to MVDAFLGTWKLVDSKNFDDYMKSLGVG-FATRQVASMTKPTTIIEKNGDILTLKTHSTF KNTEIS-FKLGVEFDETTADDRKVKSIVTLDG-GKLVHLQKWDGQETTLVRELIDGKLIL corresponding to amino acids 1-116 of AAP35373 (SEQ ID NO:348), which also corresponds to amino acids 1-116 of S67314_PEA_1_P6 (SEQ ID NO:283), and a second amino acid sequence being at least 70%, optionally at least 80%, preferably at least 85%, more preferably at least 90% and most preferably at least 95% homologous to a polypeptide having the sequence MEKLQLRNVK (SEQ ID NO:398) corresponding to amino acids 117-126 of S67314_PEA_1_P6 (SEQ ID NO:283), wherein said first and second amino acid sequences are contiguous and in a sequential order.

2. An isolated polypeptide encoding for a tail of S67314_PEA_1_P6 (SEQ ID NO:283), comprising a polypeptide being at least 70%, optionally at least about 80%, preferably at least about 85%, more preferably at least about 90% and most preferably at least about 95% homologous to the sequence MEKLQLRNVK (SEQ ID NO:398) in S67314_PEA_1_P6 (SEQ ID NO:283).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein S67314_PEA_1_P6 (SEQ ID NO:283) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein S67314_PEA_1_P6 (SEQ ID NO:283) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 53 | K -> R | Yes |

Variant protein S67314_PEA_1_P6 (SEQ ID NO:283) is encoded by the following transcript(s): S67314_PEA_1_T6 (SEQ ID NO:3), for which the sequence(s) is/are given at the end of the application. The coding portion of transcript S67314_PEA_1_T6 (SEQ ID NO:3) is shown in bold; this coding portion starts at position 925 and ends at position 1302. The transcript also has the following SNPs as listed in Table 10 (given according to their position on the nucleotide sequence, with the alternative nucleic acid listed; the last column indicates whether the SNP is known or not; the presence of known SNPs in variant protein S67314_PEA_1_P6 (SEQ ID NO:283) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 580 | T -> C | Yes |
| 1082 | A -> G | Yes |
| 1444 | T -> C | Yes |

Variant protein S67314_PEA_1_P7 (SEQ ID NO:284) according to the present invention has an amino acid sequence as given at the end of the application; it is encoded by transcript(s) S67314_PEA_1_T7 (SEQ ID NO:4). An alignment is given to the known protein (Fatty acid-binding protein, heart (SEQ ID NO:348)) at the end of the application. One or more alignments to one or more previously published protein sequences are given at the end of the application. A brief description of the relationship of the variant protein according to the present invention to each such aligned protein is as follows:

Comparison report between S67314_PEA_1_P7 (SEQ ID NO:284) and FABH_HUMAN (SEQ ID NO:348):

1. An isolated chimeric polypeptide encoding for S67314_PEA_1_P7 (SEQ ID NO:284), comprising a first amino acid sequence being at least 90% homologous to MVDAFLGTWKLVDSKNFDDYMKSL corresponding to amino acids 1-24 of FABH_HUMAN (SEQ ID NO:348), which also corresponds to amino acids 1-24 of S67314_PEA_1_P7 (SEQ ID NO:284), second amino acid sequence being at least 70%, optionally at least 80%, preferably at least 85%, more preferably at least 90% and most preferably at least 95% homologous to a polypeptide having the sequence AHILITFPLPS (SEQ ID NO:399) corresponding to amino acids 25-35 of S67314_PEA_1_P7 (SEQ ID NO:284), and a third amino acid sequence being at least 90% homologous to GVGFATRQVASMTKPTTI-IEKNGDILTLKTHSTFKNTEIS-FKLGVEFDETTADDRKVKSI VTLDGGKLVHLQK-WDGQETTLVRELIDGKLILTLTHGTAVCTRTYEKEA corresponding to amino acids 25-133 of FABH_HUMAN (SEQ ID NO:348), which also corresponds to amino acids 36-144 of S67314_PEA_1_P7 (SEQ ID NO:284), wherein said first, second, third and fourth amino acid sequences are contiguous and in a sequential order.

2. An isolated polypeptide encoding for an edge portion of S67314_PEA_1_P7 (SEQ ID NO:284), comprising an amino acid sequence being at least 70%, optionally at least about 80%, preferably at least about 85%, more preferably at least about 90% and most preferably at least about 95% homologous to the sequence encoding for AHILITFPLPS (SEQ ID NO:399), corresponding to S67314_PEA_1_P7 (SEQ ID NO:284).

Comparison report between S67314_PEA_1_P7 (SEQ ID NO:284) and AAP35373 (SEQ ID NO:348):

1. An isolated chimeric polypeptide encoding for S67314_PEA_1_P7 (SEQ ID NO:284), comprising a first amino acid sequence being at least 90% homologous to MVDAFLGTWKLVDSKNFDDYMKSL corresponding to amino acids 1-24 of AAP35373 (SEQ ID NO:348), which also corresponds to amino acids 1-24 of S67314_PEA_1_P7 (SEQ ID NO:284), second amino acid sequence being at least 70%, optionally at least 80%, preferably at least 85%, more preferably at least 90% and most preferably at least 95% homologous to a polypeptide having the sequence AHILITFPLPS (SEQ ID NO:399) corresponding to amino acids 25-35 of S67314_PEA_1_P7 (SEQ ID NO:284), and a third amino acid sequence being at least 90% homologous to GVGFATRQVASMTKPTTI-IEKNGDILTLKTHSTFKNTEIS-FKLGVEFDETTADDRKVKSI VTLDGGKLVHLQK-WDGQETTLVRELIDGKLILTLTHGTAVCTRTYEKEA corresponding to amino acids 25-133 of AAP35373 (SEQ ID NO:348), which also corresponds to amino acids 36-144 of S67314_PEA_1_P7 (SEQ ID NO:284), wherein said first, second and third amino acid sequences are contiguous and in a sequential order.

2. An isolated polypeptide encoding for an edge portion of S67314_PEA_1_P7 (SEQ ID NO:284), comprising an amino acid sequence being at least 70%, optionally at least about 80%, preferably at least about 85%, more preferably at least about 90% and most preferably at least about 95% homologous to the sequence encoding for AHILITFPLPS (SEQ ID NO:399), corresponding to S67314_PEA_1_P7 (SEQ ID NO:284).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein S67314_PEA_1_P7 (SEQ ID NO:284) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein S67314_PEA_1_P7 (SEQ ID NO:284) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 64 | K -> R | Yes |

Variant protein S67314_PEA_1_P7 (SEQ ID NO:284) is encoded by the following transcript(s): S67314_PEA_1_T7 (SEQ ID NO:4), for which the sequence(s) is/are given at the end of the application. The coding portion of transcript S67314_PEA_1_T7 (SEQ ID NO:4) is shown in bold; this coding portion starts at position 925 and ends at position 1356. The transcript also has the following SNPs as listed in Table 12 (given according to their position on the nucleotide sequence, with the alternative nucleic acid listed; the last column indicates whether the SNP is known or not; the presence of known SNPs in variant protein S67314_PEA_1_P7 (SEQ ID NO:284) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 580 | T -> C | Yes |
| 1115 | A -> G | Yes |
| 2772 | G -> A | Yes |
| 2896 | C -> A | Yes |
| 2918 | G -> C | Yes |
| 3003 | A -> G | Yes |
| 3074 | T -> G | Yes |
| 1344 | T -> C | Yes |
| 1522 | -> T | No |
| 1540 | -> A | No |
| 1540 | -> T | No |
| 1578 | G -> A | Yes |
| 1652 | G -> A | Yes |
| 2263 | G -> A | Yes |
| 2605 | T -> C | Yes |

As noted above, cluster S67314 features 8 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster S67314_PEA_1_node_0 (SEQ ID NO:65) according to the present invention is supported by 90 libraries. The number of libraries was determined as previously described. This segment can be found in the following transcript(s): S67314_PEA_1_T4 (SEQ ID NO:1), S67314_PEA_1_T5 (SEQ ID NO:2), S67314_PEA_1_T6 (SEQ ID NO:3) and S67314_PEA_1_T7 (SEQ ID NO:4). Table 13 below describes the starting and ending position of this segment on each transcript.

TABLE 13

Segment location on transcripts

| Transcript name | Segment starting position | Segment ending position |
|---|---|---|
| S67314_PEA_1_T4 (SEQ ID NO: 1) | 1 | 997 |
| S67314_PEA_1_T5 (SEQ ID NO: 2) | 1 | 997 |
| S67314_PEA_1_T6 (SEQ ID NO: 3) | 1 | 997 |
| S67314_PEA_1_T7 (SEQ ID NO: 4) | 1 | 997 |

Segment cluster S67314_PEA_1_node_11 (SEQ ID NO:66) according to the present invention is supported by 6 libraries. The number of libraries was determined as previously described. This segment can be found in the following transcript(s): S67314_PEA_1_T4 (SEQ ID NO:1). Table 14 below describes the starting and ending position of this segment on each transcript.

TABLE 14

Segment location on transcripts

| Transcript name | Segment starting position | Segment ending position |
|---|---|---|
| S67314_PEA_1_T4 (SEQ ID NO: 1) | 1273 | 2110 |

Segment cluster S67314_PEA_1_node_13 (SEQ ID NO:67) according to the present invention is supported by 76 libraries. The number of libraries was determined as previously described. This segment can be found in the following transcript(s): S67314_PEA_1_T7 (SEQ ID NO:4). Table 15 below describes the starting and ending position of this segment on each transcript.

TABLE 15

Segment location on transcripts

| Transcript name | Segment starting position | Segment ending position |
|---|---|---|
| S67314_PEA_1_T7 (SEQ ID NO: 4) | 1306 | 3531 |

Segment cluster S67314_PEA_1_node_15 (SEQ ID NO:68) according to the present invention is supported by 1 libraries. The number of libraries was determined as previously described. This segment can be found in the following transcript(s): S67314_PEA_1_T5 (SEQ ID NO:2). Table 16 below describes the starting and ending position of this segment on each transcript.

TABLE 16

Segment location on transcripts

| Transcript name | Segment starting position | Segment ending position |
|---|---|---|
| S67314_PEA_1_T5 (SEQ ID NO: 2) | 1273 | 1733 |

Segment cluster S67314_PEA_1_node_17 (SEQ ID NO:69) according to the present invention is supported by 4 libraries. The number of libraries was determined as previously described. This segment can be found in the following transcript(s): S67314_PEA_1_T6 (SEQ ID NO:3). Table 17 below describes the starting and ending position of this segment on each transcript.

TABLE 17

Segment location on transcripts

| Transcript name | Segment starting position | Segment ending position |
|---|---|---|
| S67314_PEA_1_T6 (SEQ ID NO: 3) | 1273 | 1822 |

Segment cluster S67314_PEA_1_node_4 (SEQ ID NO:70) according to the present invention is supported by 101 libraries. The number of libraries was determined as previously described. This segment can be found in the following transcript(s): S67314_PEA_1_T4 (SEQ ID NO:1), S67314_PEA_1_T5 (SEQ ID NO:2), S67314_PEA_1_T6 (SEQ ID NO:3) and S67314_PEA_

1_T7 (SEQ ID NO:4). Table 19 below describes the starting and ending position of this segment on each transcript.

TABLE 19

Segment location on transcripts

| Transcript name | Segment starting position | Segment ending position |
|---|---|---|
| S67314_PEA_1_T4 (SEQ ID NO: 1) | 998 | 1170 |
| S67314_PEA_1_T5 (SEQ ID NO: 2) | 998 | 1170 |
| S67314_PEA_1_T6 (SEQ ID NO: 3) | 998 | 1170 |
| S67314_PEA_1_T7 (SEQ ID NO: 4) | 1031 | 1203 |

According to an optional embodiment of the present invention, short segments related to the above cluster are also provided. These segments are up to about 120 bp in length, and so are included in a separate description.

Segment cluster S67314_PEA_1_node_10 (SEQ ID NO:71) according to the present invention is supported by 64 libraries. The number of libraries was determined as previously described. This segment can be found in the following transcript(s): S67314_PEA_1_T4 (SEQ ID NO:1), S67314_PEA_1_T5 (SEQ ID NO:2), S67314_PEA_1_T6 (SEQ ID NO:3) and S67314_PEA_1_T7 (SEQ ID NO:4). Table 20 below describes the starting and ending position of this segment on each transcript.

TABLE 20

Segment location on transcripts

| Transcript name | Segment starting position | Segment ending position |
|---|---|---|
| S67314_PEA_1_T4 (SEQ ID NO: 1) | 1171 | 1272 |
| S67314_PEA_1_T5 (SEQ ID NO: 2) | 1171 | 1272 |
| S67314_PEA_1_T6 (SEQ ID NO: 3) | 1171 | 1272 |
| S67314_PEA_1_T7 (SEQ ID NO: 4) | 1204 | 1305 |

Segment cluster S67314_PEA_1_node_3 (SEQ ID NO:72) according to the present invention is supported by 1 libraries. The number of libraries was determined as previously described. This segment can be found in the following transcript(s): S67314_PEA_1_T7 (SEQ ID NO:4). Table 21 below describes the starting and ending position of this segment on each transcript.

TABLE 21

Segment location on transcripts

| Transcript name | Segment starting position | Segment ending position |
|---|---|---|
| S67314_PEA_1_T7 (SEQ ID NO: 4) | 998 | 1030 |

Variant protein alignment to the previously known protein:
Sequence name: /tmp/EQ0nMn6tqU/R73CUVKUk5:FABH_HUMAN (SEQ ID NO:348)
Sequence documentation:
Alignment of: S67314_PEA_1_P4 (SEQ ID NO:281) x FABH_HUMAN (SEQ ID NO:348)

| Alignment segment 1/1: | | | |
|---|---|---|---|
| Quality: | 1095.00 | Escore: | 0 |
| Matching length: | 115 | Total length: | 115 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  2  VDAFLGTWKLVDSKNFDDYMKSLGVGFATRQVASMTKPTTIIEKNGDILT   51
     |||||||||||||||||||||||||||||||||||||||||||||||||
  1  VDAFLGTWKLVDSKNFDDYMKSLGVGFATRQVASMTKPTTIIEKNGDILT   50

52  LKTHSTFKNTEISFKLGVEFDETTADDRKVKSIVTLDGGKLVHLQKWDGQ  101
     |||||||||||||||||||||||||||||||||||||||||||||||||
 51  LKTHSTFKNTEISFKLGVEFDETTADDRKVKSIVTLDGGKLVHLQKWDGQ  100

102  ETTLVRELIDGKLIL                                    116
     |||||||||||||||
101  ETTLVRELIDGKLIL                                    115
```

Sequence name: /tmp/EQ0nMn6tqU/R73CUVKUk5: AAP35373 (SEQ ID NO:348)
Sequence documentation:
Alignment of: S67314_PEA_1_P4 (SEQ ID NO:281) x AAP35373 (SEQ ID NO:348).

| Alignment segment 1/1: | | | |
|---|---|---|---|
| Quality: | 1107.00 | Escore: | 0 |
| Matching length: | 116 | Total length: | 116 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MVDAFLGTWKLVDSKNFDDYMKSLGVGFATRQVASMTKPTTIIEKNGDIL   50
    ||||||||||||||||||||||||||||||||||||||||||||||||||
  1 MVDAFLGTWKLVDSKNFDDYMKSLGVGFATRQVASMTKPTTIIEKNGDIL   50

51 TLKTHSTFKNTEISFKLGVEFDETTADDRKVKSIVTLDGGKLVHLQKWDG  100
    |||||||||||||||||||||||||||||||||||||||||||||||||
 51 TLKTHSTFKNTEISFKLGVEFDETTADDRKVKSIVTLDGGKLVHLQKWDG  100

101 QETTLVRELIDGKLIL                                    116
    ||||||||||||||||
101 QETTLVRELIDGKLIL                                    116
```

Sequence name: /tmp/ql4YPIBbdQ/SeofJfCmJW:FABH_HUMAN (SEQ ID NO:348)

Sequence documentation:

Alignment of: S67314_PEA_1_P5 (SEQ ID NO:282) x FABH_HUMAN (SEQ ID NO:348).

| Alignment segment 1/1: | | | |
|---|---|---|---|
| Quality: | 1095.00 | Escore: | 0 |
| Matching length: | 115 | Total length: | 115 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  2 VDAFLGTWKLVDSKNFDDYMKSLGVGFATRQVASMTKPTTIIEKNGDILT   51
    |||||||||||||||||||||||||||||||||||||||||||||||||
  1 VDAFLGTWKLVDSKNFDDYMKSLGVGFATRQVASMTKPTTIIEKNGDILT   50

52 LKTHSTFKNTEISFKLGVEFDETTADDRKVKSIVTLDGGKLVHLQKWDGQ  101
    |||||||||||||||||||||||||||||||||||||||||||||||||
 51 LKTHSTFKNTEISFKLGVEFDETTADDRKVKSIVTLDGGKLVHLQKWDGQ  100

102 ETTLVRELIDGKLIL                                     116
    |||||||||||||||
101 ETTLVRELIDGKLIL                                     115
```

Sequence name: /tmp/ql4YPIBbdQ/SeofJfCmJW: AAP35373 (SEQ ID NO:348)

Sequence documentation:

Alignment of: S67314_PEA_1_P5 (SEQ ID NO:282) x AAP35373 (SEQ ID NO:348).

| Alignment segment 1/1: | | | |
|---|---|---|---|
| Quality: | 1107.00 | Escore: | 0 |
| Matching length: | 116 | Total length: | 116 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MVDAFLGTWKLVDSKNFDDYMKSLGVGFATRQVASMTKPTTIIEKNGDIL  50
    ||||||||||||||||||||||||||||||||||||||||||||||||||
  1 MVDAFLGTWKLVDSKNFDDYMKSLGVGFATRQVASMTKPTTIIEKNGDIL  50

51 TLKTHSTFKNTEISFKLGVEFDETTADDRKVKSIVTLDGGKLVHLQKWDG 100
    |||||||||||||||||||||||||||||||||||||||||||||||||
 51 TLKTHSTFKNTEISFKLGVEFDETTADDRKVKSIVTLDGGKLVHLQKWDG 100

101 QETTLVRELIDGKLIL                                   116
    ||||||||||||||||
101 QETTLVRELIDGKLIL                                   116
```

Sequence name:/tmp/PXra2DxL1v/Q8GTrzNMVX:FABH_HUMAN (SEQ ID NO:348)

Sequence documentation:

Alignment of: S67314_PEA_1_P6 (SEQ ID NO:283) x FABH_HUMAN (SEQ ID NO:348).

| Alignment segment 1/1: | | | |
|---|---|---|---|
| Quality: | 1095.00 | Escore: | 0 |
| Matching length: | 115 | Total length: | 115 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  2 VDAFLGTWKLVDSKNFDDYMKSLGVGFATRQVASMTKPTTIIEKNGDILT  51
    |||||||||||||||||||||||||||||||||||||||||||||||||
  1 VDAFLGTWKLVDSKNFDDYMKSLGVGFATRQVASMTKPTTIIEKNGDILT  50

52 LKTHSTFKNTEISFKLGVEFDETTADDRKVKSIVTLDGGKLVHLQKWDGQ 101
    |||||||||||||||||||||||||||||||||||||||||||||||||
 51 LKTHSTFKNTEISFKLGVEFDETTADDRKVKSIVTLDGGKLVHLQKWDGQ 100

102 ETTLVRELIDGKLIL                                    116
    |||||||||||||||
101 ETTLVRELIDGKLIL                                    115
```

Sequence name: /tmp/PXra2DxL1v/Q8GTrzNMVX:AAP35373 (SEQ ID NO:348)

Sequence documentation:

Alignment of: S67314_PEA_1_P6 (SEQ ID NO:283) x AAP35373 (SEQ ID NO:348).

| Alignment segment 1/1: | | | |
|---|---|---|---|
| Quality: | 1107.00 | Escore: | 0 |
| Matching length: | 116 | Total length: | 116 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MVDAFLGTWKLVDSKNFDDYMKSLGVGFATRQVASMTKPTTIIEKNGDIL    50
     ||||||||||||||||||||||||||||||||||||||||||||||||||
  1  MVDAFLGTWKLVDSKNFDDYMKSLGVGFATRQVASMTKPTTIIEKNGDIL    50

51  TLKTHSTFKNTEISFKLGVEFDETTADDRKVKSIVTLDGGKLVHLQKWDG   100
     |||||||||||||||||||||||||||||||||||||||||||||||||
 51  TLKTHSTFKNTEISFKLGVEFDETTADDRKVKSIVTLDGGKLVHLQKWDG   100

101  QETTLVRELIDGKLIL                                     116
     ||||||||||||||||
101  QETTLVRELIDGKLIL                                     116
```

Sequence name: /tmp/xYzWyViDom/twDu3T69pd:FABH_HUMAN (SEQ ID NO:348)

Sequence documentation:

Alignment of: S67314_PEA_1_P7 (SEQ ID NO:284) x FABH_HUMAN (SEQ ID NO:348).

| Alignment segment 1/1: | | | |
|---|---|---|---|
| Quality: | 1160.00 | Escore: | 0 |
| Matching length: | 132 | Total length: | 143 |
| Matching Percent Similarity: | 100.00 | Matching Percent Identity: | 100.00 |
| Total Percent Similarity: | 92.31 | Total Percent Identity: | 92.31 |
| Gaps: | 1 | | |

Alignment:

```
  2  VDAFLGTWKLVDSKNFDDYMKSLAHILITFPLPSGVGFATRQVASMTKPT    51
     |||||||||||||||||||||||           |||||||||||||||
  1  VDAFLGTWKLVDSKNFDDYMKSL...........GVGFATRQVASMTKPT    39

52  TIIEKNGDILTLKTHSTFKNTEISFKLGVEFDETTADDRKVKSIVTLDGG   101
     |||||||||||||||||||||||||||||||||||||||||||||||||
 40  TIIEKNGDILTLKTHSTFKNTEISFKLGVEFDETTADDRKVKSIVTLDGG    89

102  KLVHLQKWDGQETTLVRELIDGKLILTLTHGTAVCTRTYEKEA          144
     ||||||||||||||||||||||||||||||||||||||||||
 90  KLVHLQKWDGQETTLVRELIDGKLILTLTHGTAVCTRTYEKEA          132
```

Sequence name: /tmp/xYzWyViDom/twDu3T69pd:AAP35373 (SEQ ID NO:348)

Sequence documentation:

Alignment of: S67314_PEA_1_P7 (SEQ ID NO:284) x AAP35373 (SEQ ID NO:348).

| Alignment segment 1/1: | | | |
|---|---|---|---|
| Quality: | 1172.00 | Escore: | 0 |
| Matching length: | 133 | Total length: | 144 |
| Matching Percent Similarity: | 100.00 | Matching Percent Identity: | 100.00 |
| Total Percent Similarity: | 92.36 | Total Percent Identity: | 92.36 |
| Gaps: | 1 | | |

Alignment:

```
  1  MVDAFLGTWKLVDSKNFDDYMKSLAHILITFPLPSGVGFATRQVASMTKP   50
     ||||||||||||||||||||||||              ||||||||||||||
  1  MVDAFLGTWKLVDSKNFDDYMKSL...........GVGFATRQVASMTKP   39

51  TTIIEKNGDILTLKTHSTFKNTEISFKLGVEFDETTADDRKVKSIVTLDG  100
     |||||||||||||||||||||||||||||||||||||||||||||||||
 40  TTIIEKNGDILTLKTHSTFKNTEISFKLGVEFDETTADDRKVKSIVTLDG   89

101  GKLVHLQKWDGQETTLVRELIDGKLILTLTHGTAVCTRTYEKEA        144
     |||||||||||||||||||||||||||||||||||||||||||
 90  GKLVHLQKWDGQETTLVRELIDGKLILTLTHGTAVCTRTYEKEA        133
```

Expression of FABH_HUMAN Fatty acid-binding protein transcripts which are detectable by amplicon as depicted in sequence name S67314 specifically in heart tissue.

Expression of FABH_HUMAN Fatty acid-binding protein transcripts detectable by or according to seg11, S67314 amplicon(s) and S67314 seg11F (SEQ ID NO:61) and S67314 seg11R (SEQ ID NO:62) primers was measured by real time PCR. In parallel the expression of four housekeeping genes—RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)), Ubiquitin (GenBank Accession No. BC000449 (SEQ ID NO:445); amplicon—Ubiquitin-amplicon (SEQ ID NO:448)) and SDHA (GenBank Accession No. NM_004168 (SEQ ID NO:449); amplicon—SDHA-amplicon (SEQ ID NO:452)) was measured similarly. For each RT sample, the expression of the above amplicons was normalized to the geometric mean of the quantities of the housekeeping genes. The normalized quantity of each RT sample was then divided by the median of the quantities of the heart samples (Sample Nos. 44, 45, 46, Table 1, "Tissue samples in testing panel", above), to obtain a value of fold up-regulation for each sample relative to median of the heart.

FIG. 5A is a histogram showing specific expression of the above-indicated FABH_HUMAN Fatty acid-binding protein transcripts in heart tissue samples as opposed to other tissues.

As is evident from FIG. 5A, the expression of FABH_HUMAN Fatty acid-binding protein transcripts detectable by the above amplicon(s) in heart tissue samples was significantly higher than in most other samples (non heart tissue sample Nos. 1-11, 13-21, 23-26, 28-43, 47-74, Table 1 above, "Tissue samples in testing panel").

Primer pairs are also optionally and preferably encompassed within the present invention; for example, for the above experiment, the following primer pair was used as a non-limiting illustrative example only of a suitable primer pair: S67314 seg11F (SEQ ID NO:61) forward primer; and S67314 seg11R (SEQ ID NO:62) reverse primer.

The present invention also preferably encompasses any amplicon obtained through the use of any suitable primer pair; for example, for the above experiment, the following amplicon was obtained as a non-limiting illustrative example only of a suitable amplicon: S67314 seg11 (SEQ ID NO:63).

S67314 seg11F (SEQ ID NO:61): TCCCCTGAGAGCTGTAGAAGCT

S67314 seg11R (SEQ ID NO:62): CGGCCTGTGTGAGTCCAAA

S67314 seg11 (SEQ ID NO:63): TCCCCTGAGAGCTGTAGAAGCTGGGACAAGAGAGTGGTTGTGGGTCAGGGTGGTATCAGGTGGGAATTTTCTGTGTAGTGGCTTTGGACTCACACAGGCCG Expression of FABH_HUMAN Fatty acid-binding protein S67314 transcripts, which are detectable by amplicon as depicted in sequence name S67314 seg15 specifically in heart tissue Expression of FABH_HUMAN Fatty acid-binding protein transcripts detectable by or according to seg15 node(s), S67314 seg15 amplicon(s) and S67314 seg15F and S67314 seg15R primers was measured by real time PCR. In parallel the expression of four housekeeping genes—RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)), Ubiquitin (GenBank Accession No. BC000449 (SEQ ID NO:445); amplicon—Ubiquitin-amplicon (SEQ ID NO:448)) and SDHA (GenBank Accession No. NM_004168 (SEQ ID NO:449); amplicon—SDHA-amplicon (SEQ ID NO:452)), was measured similarly. For each RT sample, the expression of the above amplicons was normalized to the geometric mean of the quantities of the housekeeping genes. The normalized quantity of each RT sample was then divided by the median of the quantities of the heart samples (Sample Nos. 44-46, Table 1, above "Tissue samples in testing panel"), to obtain a value of fold up-regulation for each sample relative to median of the heart.

Figure 5B:
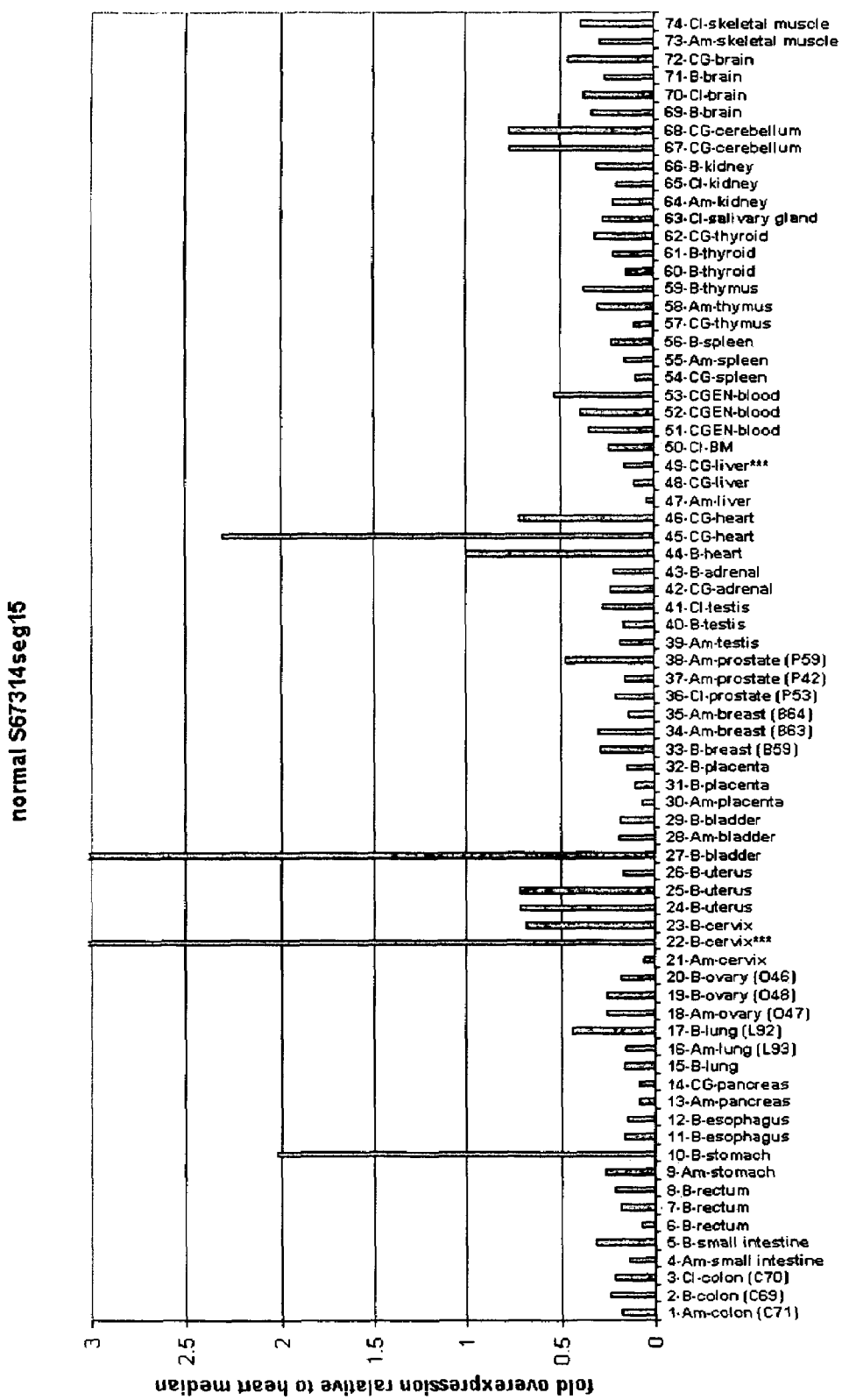
FIG. 5B is a histogram showing specific expression of variant FABH_HUMAN protein transcripts (SEQ ID NO:275).

FIG. 5B is a histogram showing specific expression of the above-indicated FABH_HUMAN Fatty acid-binding protein transcripts in heart tissue samples as opposed to other tissues.

As is evident from FIG. 5B, the expression of FABH_HUMAN Fatty acid-binding protein transcripts detectable by the above amplicon(s) in heart tissue samples was significantly higher than in most other samples (non-heart tissue sample Nos. 1-9, 11-21, 23-26, 28-43, 47-74 Table 1 above, "Tissue samples in testing panel").

Primer pairs are also optionally and preferably encompassed within the present invention; for example, for the above experiment, the following primer pair was used as a non-limiting illustrative example only of a suitable primer pair: S67314 seg15F Forward primer (SEQ ID NO:64); and S67314 seg15R Reverse primer (SEQ ID NO:274).

The present invention also preferably encompasses any amplicon obtained through the use of any suitable primer pair; for example, for the above experiment, the following amplicon was obtained as a non-limiting illustrative example only of a suitable amplicon: S67314 seg15.

S67314 seg15F (SEQ ID NO:64) Forward primer:
TTCCTTGGCATCTCCAATGG

S67314 seg15R (SEQ ID NO:274) Reverse primer:
GCCAACTCTCAGCTCCTCCC

S67314 seg15 (SEQ ID NO:275) Amplicon:
TTCCTTGGCATCTCCAATGGAGTAGAGAGAAGGCAACAAAGCTTCTCAG
ACCCACATTACCGAGCTATAACAACCATGGCTGGGAGGAGCTGAGAGTT
GGC Expression of FABH_HUMAN Fatty acid-binding protein S67314 transcripts which are detectable by amplicon as depicted in sequence name S67314seg4 specifically in heart tissue Expression of FABH_HUMAN Fatty acid-binding protein transcripts detectable by or according to seg4 node(s), S67314 seg4 amplicon(s) and primers S67314seg4F and S67314seg4R was measured by real time PCR (this transcript corresponds to the known or WT protein). In parallel the expression of four housekeeping genes—RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)), Ubiquitin (GenBank Accession No. BC000449 (SEQ ID NO:445); amplicon—Ubiquitin-amplicon (SEQ ID NO:448)) and SDHA (GenBank Accession No. NM_004168 (SEQ ID NO:449); amplicon—SDHA-amplicon (SEQ ID NO:452)), was measured similarly. For each RT sample, the expression of the above amplicons was normalized to the geometric mean of the quantities of the housekeeping genes. The normalized quantity of each RT sample was then divided by the median of the quantities of the heart samples (Sample Nos. 44-46, Table 1, above), to obtain a value of relative expression for each sample relative to median of the heart samples.

Figure 6:
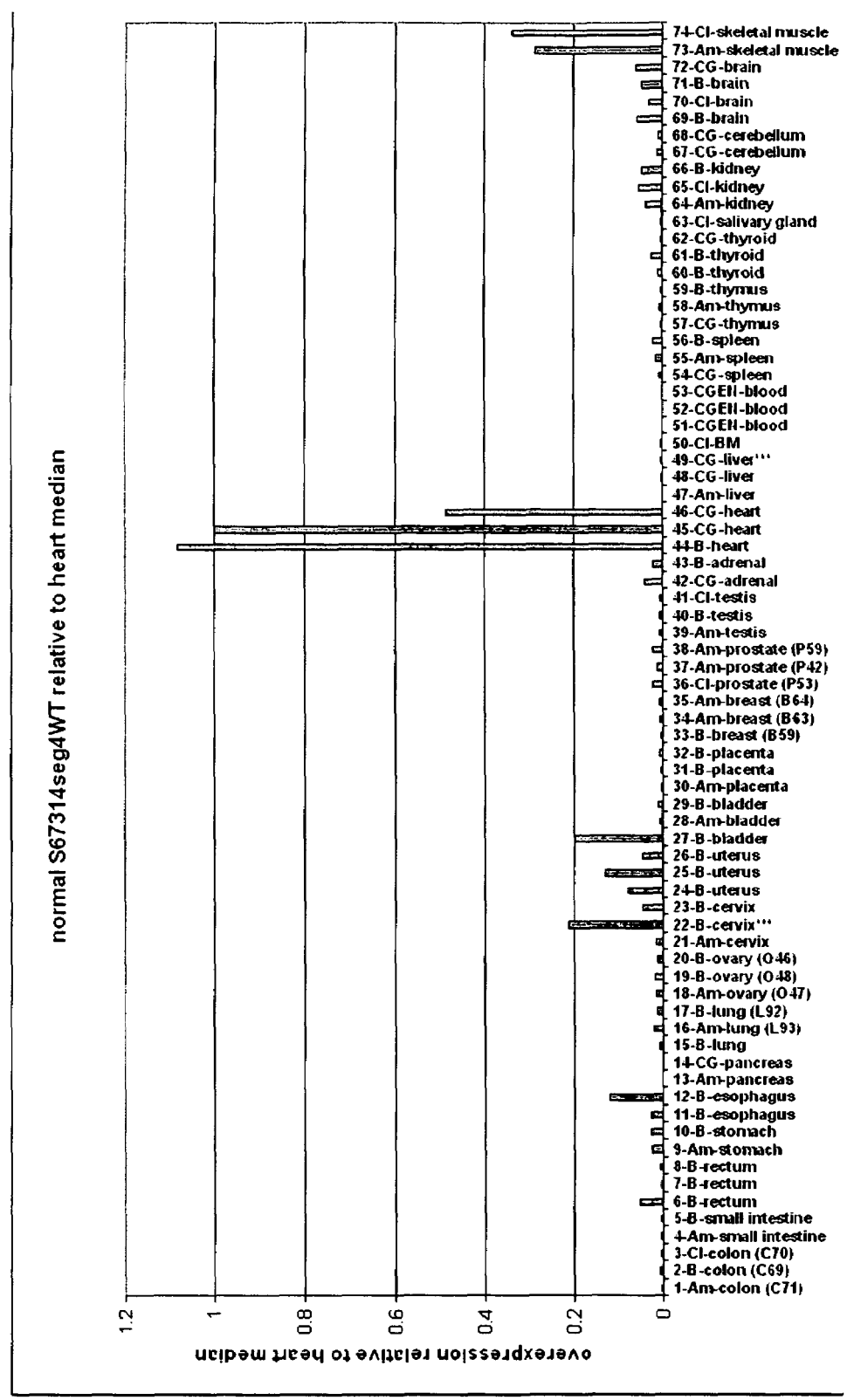
FIG. 6 is a histrogram showing expression of FABH_HUMAN known protein transcripts (SEQ ID NO:278).

FIG. 6 is a histogram showing relative expression of the above-indicated FABH_HUMAN Fatty acid-binding protein transcripts in heart tissue samples as opposed to other tissues.

As is evident from FIG. 6, the expression of FABH_HUMAN Fatty acid-binding protein transcripts detectable by the above amplicon(s) in heart tissue samples was significantly higher than in the other samples (Sample Nos. 44-46 Table 1, "Tissue samples in testing panel").

Primer pairs are also optionally and preferably encompassed within the present invention; for example, for the above experiment, the following primer pair was used as a non-limiting illustrative example only of a suitable primer pair: S67314seg4F forward primer (SEQ ID NO:276); and S67314seg4R reverse primer (SEQ ID NO:277).

The present invention also preferably encompasses any amplicon obtained through the use of any suitable primer pair; for example, for the above experiment, the following amplicon was obtained as a non-limiting illustrative example only of a suitable amplicon: S67314seg4.

Forward primer S67314seg4F (SEQ ID NO:276):
CCAAGCCTACCACAATCATCG

Reverse primer S67314seg4R (SEQ ID NO:277):
CTCCACCCCCAACTTAAAGCT

Amplicon S67314seg4 (SEQ ID NO:278):
CCAAGCCTACCACAATCATCGAAAAGAATGGGGACATTCTCACCCTAAAA
ACACACAGCACCTTCAAGAACACAGAGATCAGCTTTAAGTTGGGGGTGG
AG Description for Cluster N56180

Cluster N56180 features 7 transcript(s) and 22 segment(s) of interest, the names for which are given in Tables 1 and 2, respectively, the sequences themselves are given at the end of the application. The selected protein variants are given in table 3.

TABLE 1

Transcripts of interest

| Transcript Name | Seq ID No. |
| --- | --- |
| N56180_T1 | 5 |
| N56180_T3 | 6 |
| N56180_T4 | 7 |
| N56180_T5 | 8 |
| N56180_T6 | 9 |
| N56180_T7 | 10 |
| N56180_T8 | 11 |

TABLE 2

Segments of interest

| Segment Name | Seq ID No. |
| --- | --- |
| N56180_node_2 | 73 |
| N56180_node_20 | 74 |
| N56180_node_22 | 75 |
| N56180_node_28 | 76 |
| N56180_node_34 | 77 |
| N56180_node_36 | 78 |
| N56180_node_4 | 79 |
| N56180_node_6 | 80 |
| N56180_node_0 | 81 |
| N56180_node_10 | 82 |
| N56180_node_12 | 83 |
| N56180_node_14 | 84 |
| N56180_node_16 | 85 |
| N56180_node_18 | 86 |
| N56180_node_24 | 87 |
| N56180_node_26 | 88 |
| N56180_node_29 | 89 |
| N56180_node_3 | 90 |
| N56180_node_31 | 91 |
| N56180_node_33 | 92 |
| N56180_node_35 | 93 |
| N56180_node_8 | 94 |

TABLE 3

Proteins of interest

| Protein Name | Seq ID No. |
| --- | --- |
| N56180_P2 | 285 |
| N56180_P4 | 286 |
| N56180_P5 | 287 |
| N56180_P6 | 288 |
| N56180_P7 | 289 |
| N56180_P8 | 290 |
| N56180_P9 | 291 |

These sequences are variants of the known protein Calsequestrin, cardiac muscle isoform precursor (SEQ ID NO:349) (SwissProt accession identifier CAQ2_HUMAN; known also according to the synonyms Calsequestrin 2), referred to herein as the previously known protein.

Protein Calsequestrin, cardiac muscle isoform precursor (SEQ ID NO:349) is known or believed to have the following function(s): Calsequestrin is a high-capacity, moderate affinity, calcium-binding protein and thus acts as an internal calcium store in muscle. The release of calcium bound to calsequestrin through a calcium release channel triggers muscle contraction. The protein binds 40 to 50 moles of calcium. The sequence for protein Calsequestrin, cardiac muscle isoform precursor is given at the end of the application, as "Calsequestrin, cardiac muscle isoform precursor amino acid sequence" (SEQ ID NO:349). Known polymorphisms for this sequence are as shown in Table 4.

TABLE 4

Amino acid mutations for Known Protein

| SNP position(s) on amino acid sequence | Comment |
|---|---|
| 307 | D -> H (in VTSIP). /FTId=VAR_016075. |
| 67 | Q -> P |

Protein Calsequestrin, cardiac muscle isoform precursor (SEQ ID NO:349) localization is believed to be in the sarcoplasmic reticulum's terminal cisternae luminal spaces of cardiac and slow skeletal muscle cells.

The following GO Annotation(s) apply to the previously known protein. The following annotation(s) were found: striated muscle contraction; heart development; muscle development, which are annotation(s) related to Biological Process; calcium storage, which are annotation(s) related to Molecular Function; and smooth endoplasmic reticulum, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

The heart-selective diagnostic marker prediction engine provided the following results with regard to cluster N56180. Predictions were made for selective expression of transcripts of this cluster in heart tissue, according to the previously described methods. The numbers on the y-axis of FIG. 7 refer to weighted expression of ESTs in each category, as "parts per million" (ratio of the expression of ESTs for a particular cluster to the expression of all ESTs in that category, according to parts per million).

Figure 7:
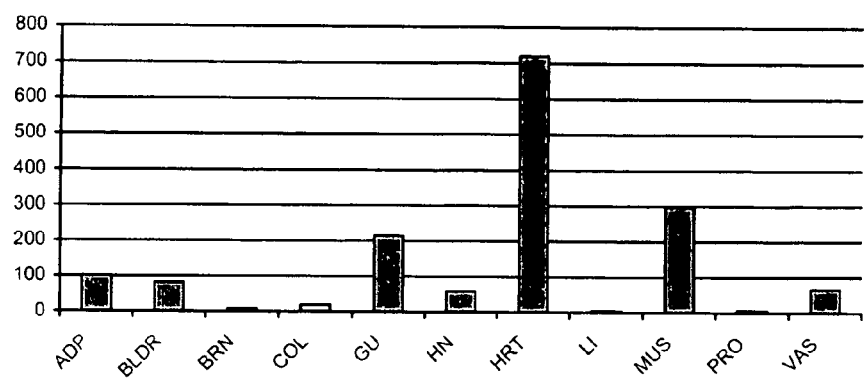
FIG. 7 is a histogram showing expression of the number of heart tissue-specific clones in libraries/sequences.
Figure 8:
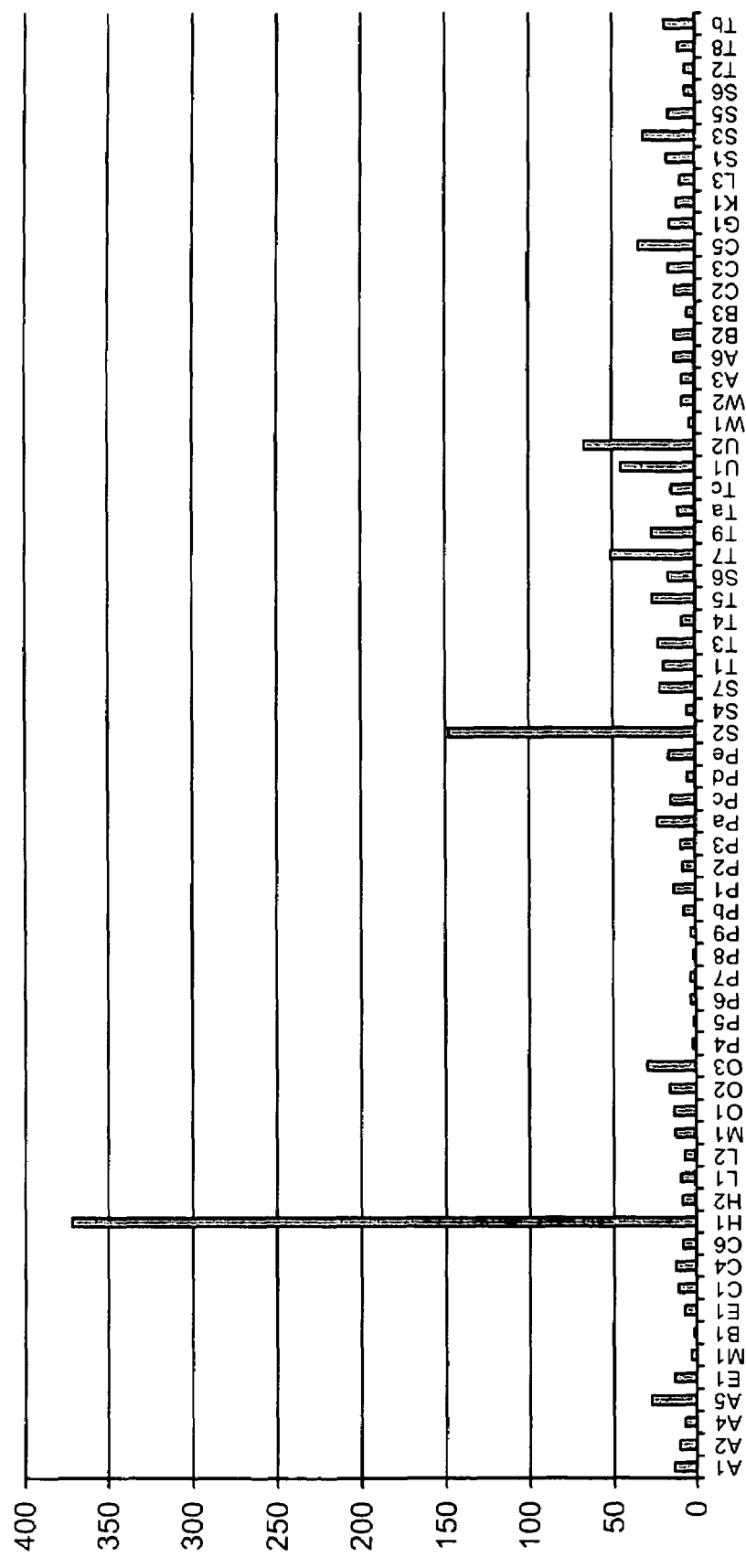
FIG. 8 is a histogram showing the actual expression of oligonucleotides in various tissues, including heart tissue, prob 207317_s_at (SEQ ID NO:392).

Overall, the following results were obtained as shown with regard to the histogram in FIG. 7, concerning the number of heart-specific clones in libraries/sequences; as well as with regard to the histogram in FIG. 8, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs was found to be 11; the ratio of expression of the cluster in heart specific ESTs to the overall expression of the cluster in muscle-specific ESTs was found to be 2.4; and fisher exact test P-values were computed both for library and weighted clone counts to check that the counts are statistically significant, and were found to be 4.70E-14.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs was found to be 2.4, which clearly supports specific expression in heart tissue.

As noted above, cluster N56180 features 7 transcript(s), which were listed in Table 1 above. These transcript(s) encode for protein(s) which are variant(s) of protein Calsequestrin, cardiac muscle isoform precursor (SEQ ID NO:349). A description of each variant protein according to the present invention is now provided.

Variant protein N56180_P2 (SEQ ID NO:285) according to the present invention has an amino acid sequence as given at the end of the application; it is encoded by transcript(s) N56180_T1 (SEQ ID NO:5). An alignment is given to the known protein (Calsequestrin, cardiac muscle isoform precursor (SEQ ID NO:349)) at the end of the application. One or more alignments to one or more previously published protein sequences are given at the end of the application. A brief description of the relationship of the variant protein according to the present invention to each such aligned protein is as follows:

Comparison report between N56180_P2 (SEQ ID NO:285) and CAQ2_HUMAN (SEQ ID NO:349):

1. An isolated chimeric polypeptide encoding for N56180_P2 (SEQ ID NO:285), comprising a first amino acid sequence being at least 90% homologous to MKRTHLFIVGIYFLSSCRAEEGLNFP-TYDGKDRVVSLSEKNFKQVLKKYDLLCLYYHEP VSSDKVTQKQFQLKEIVLELVAQVLEH-KAIGFVMVDAKKEAKLAKKLGFDEEGSLYIL KGDRTIEFDGEFAADVLVEFLLDLIED-PVEIISSKLEVQAFERIEDYIKLIGFFKSEDSEYY KAF-EEAAEHFQPYIKFFATFDKGV corresponding to amino acids 1-203 of CAQ2_HUMAN (SEQ ID NO:349), which also corresponds to amino acids 1-203 of N56180_P2 (SEQ ID NO:285), and a second amino acid sequence being at least 70%, optionally at least 80%, preferably at least 85%, more preferably at least 90% and most preferably at least 95% homologous to a polypeptide having the sequence LWLTPVIPTLWEADGGGLHEPWSWRPA-WATWLQRNYL (SEQ ID NO:400) corresponding to amino acids 204-240 of N56180_P2 (SEQ ID NO:285), wherein said first and second amino acid sequences are contiguous and in a sequential order.

2. An isolated polypeptide encoding for a tail of N56180_P2 (SEQ ID NO:285), comprising a polypeptide being at least 70%, optionally at least about 80%, preferably at least about 85%, more preferably at least about 90% and most preferably at least about 95% homologous to the sequence LWLTPVIPTLWEADGGGLHEPWSWRPA-WATWLQRNYL (SEQ ID NO:400) in N56180_P2 (SEQ ID NO:285).

The location of the variant protein was determined according to results from a number of different software programs and analyses, including analyses from SignalP and other specialized programs. The variant protein is believed to be located as follows with regard to the cell: secreted or localized in the sarcoplasmic reticulum's terminal cisternae luminal spaces of cardiac and slow skeletal muscle cells like the WT protein. The protein localization is believed to be secreted because both signal-peptide prediction programs predict that this protein has a signal peptide, and neither trans-membrane region prediction program predicts that this protein has a trans-membrane region.

Variant protein N56180_P2 (SEQ ID NO:285) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein N56180_P2 (SEQ ID NO:285) sequence provides support for the deduced sequence of this variant protein according to the present invention).

TABLE 7

Amino acid mutations

| SNP position(s) on amino acid sequence | Alternative amino acid(s) | Previously known SNP? |
|---|---|---|
| 66 | T -> A | Yes |
| 76 | V -> M | Yes |

Variant protein N56180_P2 (SEQ ID NO:285) is encoded by the following transcript(s): N56180_T1 (SEQ ID NO:5), for which the sequence(s) is/are given at the end of the application. The coding portion of transcript N56180_T1 (SEQ ID NO:5) is shown in bold; this coding portion starts at position 242 and ends at position 961. The transcript also has the following SNPs as listed in Table 8 (given according to their position on the nucleotide sequence, with the alternative nucleic acid listed; the last column indicates whether the SNP is known or not; the presence of known SNPs in variant protein N56180_P2 (SEQ ID NO:285) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 74 | T -> | No |
| 105 | T -> C | Yes |
| 2168 | C -> G | Yes |
| 2289 | G -> T | No |
| 2489 | A -> C | No |
| 2545 | A -> | Yes |
| 2638 | A -> T | Yes |
| 206 | G -> A | Yes |
| 221 | G -> A | Yes |
| 228 | A -> C | Yes |
| 437 | A -> G | Yes |
| 467 | G -> A | Yes |
| 1021 | A -> | No |
| 1521 | C -> T | Yes |
| 2018 | C -> T | Yes |

Variant protein N56180_P4 (SEQ ID NO:286) according to the present invention has an amino acid sequence as given at the end of the application; it is encoded by transcript(s) N56180_T3 (SEQ ID NO:6). An alignment is given to the known protein (Calsequestrin, cardiac muscle isoform precursor (SEQ ID NO:349)) at the end of the application. One or more alignments to one or more previously published protein sequences are given at the end of the application. A brief description of the relationship of the variant protein according to the present invention to each such aligned protein is as follows:

Comparison report between N56180_P4 (SEQ ID NO:286) and CAQ2_HUMAN (SEQ ID NO:349):

1. An isolated chimeric polypeptide encoding for N56180_P4 (SEQ ID NO:286), comprising a first amino acid sequence being at least 90% homologous to MKRTHLFIVGIYFLSSCRAEEGLNFPTYDGKDRVVSLSEKNFKQVLKKYDLLCLYYHEPVSSDKVTQKQFQLKEIVLE corresponding to amino acids 1-78 of CAQ2_HUMAN (SEQ ID NO:349), which also corresponds to amino acids 1-78 of N56180_P4 (SEQ ID NO:286), second amino acid sequence being at least 70%, optionally at least 80%, preferably at least 85%, more preferably at least 90% and most preferably at least 95% homologous to a polypeptide having the sequence HWQISQWWLHFQTPREEGKMKLLELSESADGAAWKRWGGNSNTHRIQ (SEQ ID NO:401) corresponding to amino acids 79-125 of N56180_P4 (SEQ ID NO:286), and a third amino acid sequence being at least 90% homologous to LVAQVLEHKAIGFVMVDAKKEAKLAKKLGFDEEGSLYILKGDRTIEFDGEFAADVLVE FLLDLIEDPVEIISSKLEVQAFERIEDYIKLIGFFKSEDSEYYKAFEEAAE HFQPYIKFFATF DKGVAKKLSLKMNEVDFYEPFMDEPIAIPNKPYTEEELVEFVKEHQRPTLRRLRPEEMF ETWEDDLNGIHIVAFAEKSDPDGYEFLEILKQVARDNTDNPDLSILWIDPDDFPLLVAY WEKTFKIDLFRPQIGVVNVTDADSVWMEIPDDDDLPTAEELEDWIEDVLSGKINTEDDD EDDDDDDNSDEEDNDDSDDDDDE corresponding to amino acids 79-399 of CAQ2_HUMAN (SEQ ID NO:349), which also corresponds to amino acids 126-446 of N56180_P4 (SEQ ID NO:286), wherein said first, second and third amino acid sequences are contiguous and in a sequential order.

2. An isolated polypeptide encoding for an edge portion of N56180_P4 (SEQ ID NO:286), comprising an amino acid sequence being at least 70%, optionally at least about 80%, preferably at least about 85%, more preferably at least about 90% and most preferably at least about 95% homologous to the sequence encoding for HWQISQWWLHFQTPREEGKMKLLELSESADGAAWKRWGGNSNTHRIQ (SEQ ID NO:401), corresponding to N56180_P4 (SEQ ID NO:286).

The location of the variant protein was determined according to results from a number of different software programs and analyses, including analyses from SignalP and other specialized programs. The variant protein is believed to be located as follows with regard to the cell: secreted or localized in the sarcoplasmic reticulum's terminal cisternae luminal spaces of cardiac and slow skeletal muscle cells like the WT protein. The protein localization is believed to be secreted because both signal-peptide prediction programs predict that this protein has a signal peptide, and neither trans-membrane region prediction program predicts that this protein has a trans-membrane region.

Variant protein N56180_P4 (SEQ ID NO:286) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein N56180_P4 (SEQ ID NO:286) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 115 | W -> R | Yes |
| 276 | N -> | No |
| 66 | T -> A | Yes |
| 76 | V -> M | Yes |

Variant protein N56180_P4 (SEQ ID NO:286) is encoded by the following transcript(s): N56180_T3 (SEQ ID NO:6), for which the sequence(s) is/are given at the end of the application. The coding portion of transcript N56180_T3 (SEQ ID NO:6) is shown in bold; this coding portion starts at position 242 and ends at position 1579. The transcript also has the following SNPs as listed in Table 10 (given according to their position on the nucleotide sequence, with the alternative nucleic acid listed; the last column indicates whether the SNP is known or not; the presence of known SNPs in variant protein N56180_P4 (SEQ ID NO:286) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 74 | T -> | No |
| 105 | T -> C | Yes |
| 2064 | C -> T | Yes |
| 2214 | C -> G | Yes |
| 2335 | G -> T | No |
| 2535 | A -> C | No |
| 2591 | A -> | Yes |
| 2684 | A -> T | Yes |
| 206 | G -> A | Yes |
| 221 | G -> A | Yes |
| 228 | A -> C | Yes |
| 437 | A -> G | Yes |
| 467 | G -> A | Yes |
| 584 | T -> C | Yes |
| 1067 | A -> | No |
| 1567 | C -> T | Yes |

Variant protein N56180_P5 (SEQ ID NO:287) according to the present invention has an amino acid sequence as given at the end of the application; it is encoded by transcript(s) N56180_T4 (SEQ ID NO:7). An alignment is given to the known protein (Calsequestrin, cardiac muscle isoform precursor (SEQ ID NO:349)) at the end of the application. One or more alignments to one or more previously published protein sequences are given at the end of the application. A brief description of the relationship of the variant protein according to the present invention to each such aligned protein is as follows:

Comparison report between N56180_P5 (SEQ ID NO:287) and CAQ2_HUMAN (SEQ ID NO:349):

1. An isolated chimeric polypeptide encoding for N56180_P5 (SEQ ID NO:287), comprising a first amino acid sequence being at least 90% homologous to MKRTH-LFIVGIYFLSSCRAEEGLNFP-
TYDGKDRVVSLSEKNFKQVLKKYDLLCLYYHEP VSSDKVTQKQFQLKEIVLELVAQVLEH-
KAIGFVMVDAKKEAKLAKKLGFDEEGSLYIL KGDRTIEFDGEFAADVLVEFLLD corresponding to amino acids 1-140 of CAQ2_HUMAN (SEQ ID NO:349), which also corresponds to amino acids 1-140 of N56180_P5 (SEQ ID NO:287), and a second amino acid sequence being at least 90% homologous to VAKKLSLKMNEVD-FYEPFMDEPIAIPNKPYTEEELVEFVKE-
HQRPTLRRLRPEEMFETW EDDLNGIHIVAFAEKSDP-DGYEFLEILKQVARDNTDNPDLSILWIDPDDFPLLVA YWEKT FKIDLFRPQIGVVNVTDADSVWMEIPD-DDDLPTAEELEDWIEDVLSGKINTEDDDEDDD DDD-NSDEEDNDDSDDDDDE corresponding to amino acids 203-399 of CAQ2_HUMAN (SEQ ID NO:349), which also corresponds to amino acids 141-337 of N56180_P5 (SEQ ID NO:287), wherein said first and second amino acid sequences are contiguous and in a sequential order.

2. An isolated chimeric polypeptide encoding for an edge portion of N56180_P5 (SEQ ID NO:287), comprising a polypeptide having a length "n", wherein "n" is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DV, having a structure as follows: a sequence starting from any of amino acid numbers 140−x to 140; and ending at any of amino acid numbers 141+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted or localized in the sarcoplasmic reticulum's terminal cisternae luminal spaces of cardiac and slow skeletal muscle cells like the WT protein. The protein localization is believed to be secreted because both signal-peptide prediction programs predict that this protein has a signal peptide, and neither trans-membrane region prediction program predicts that this protein has a trans-membrane region.

Variant protein N56180_P5 (SEQ ID NO:287) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein N56180_P5 (SEQ ID NO:287) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 167 | N -> | No |
| 66 | T -> A | Yes |
| 76 | V -> M | Yes |

Variant protein N56180_P5 (SEQ ID NO:287) is encoded by the following transcript(s): N56180_T4 (SEQ ID NO:7), for which the sequence(s) is/are given at the end of the application. The coding portion of transcript N56180_T4 (SEQ ID NO:7) is shown in bold; this coding portion starts at position 242 and ends at position 1252. The transcript also has the following SNPs as listed in Table 12 (given according to their position on the nucleotide sequence, with the alternative nucleic acid listed; the last column indicates whether the SNP is known or not; the presence of known SNPs in variant protein N56180_P5 (SEQ ID NO:287) sequence provides support for the deduced sequence of this variant protein according to the present invention).

TABLE 12

Nucleic acid SNPs

| SNP position on nucleotide sequence | Alternative nucleic acid | Previously known SNP? |
| --- | --- | --- |
| 74 | T -> | No |
| 105 | T -> C | Yes |
| 1887 | C -> G | Yes |
| 2008 | G -> T | No |
| 2208 | A -> C | No |
| 2264 | A -> | Yes |
| 2357 | A -> T | Yes |
| 206 | G -> A | Yes |
| 221 | G -> A | Yes |
| 228 | A -> C | Yes |
| 437 | A -> G | Yes |
| 467 | G -> A | Yes |
| 740 | A -> | No |
| 1240 | C -> T | Yes |
| 1737 | C -> T | Yes |

Variant protein N56180_P6 (SEQ ID NO:288) according to the present invention has an amino acid sequence as given at the end of the application; it is encoded by transcript(s) N56180_T5 (SEQ ID NO:8). An alignment is given to the known protein (Calsequestrin, cardiac muscle isoform precursor (SEQ ID NO:349)) at the end of the application. One or more alignments to one or more previously published protein sequences are given at the end of the application. A brief description of the relationship of the variant protein according to the present invention to each such aligned protein is as follows:

Comparison report between N56180_13 P6 (SEQ ID NO:288) and CAQ2_HUMAN (SEQ ID NO:349):

1. An isolated chimeric polypeptide encoding for N56180_P6 (SEQ ID NO:288), comprising a first amino acid sequence being at least 70%, optionally at least 80%, preferably at least 85%, more preferably at least 90% and most preferably at least 95% homologous to a polypeptide having the sequence NETEAEQSYV (SEQ ID NO:402) corresponding to amino acids 1-10 of N56180_P6 (SEQ ID NO:288), second amino acid sequence being at least 90% homologous to RAEEGLNFPTYDGKDRV-VSLSEKNFKQVLKKYDLLCLYYHEPVSS-DKVTQKQFQLKEI VLELVAQVLEHKAIGFVM-VDAKKEAKLAKKL corresponding to amino acids 18-106 of CAQ2_HUMAN (SEQ ID NO:349), which also corresponds to amino acids 11-99 of N56180_P6 (SEQ ID NO:288), a third (bridging) amino acid sequence comprising D, and a fourth amino acid sequence being at least 90% homologous to YKAFEEAAEHFQPYIKFFATFDKG-VAKKLSLKMNEVDFYEPFMDEPIAIPNKPYTEEEL VEFVKEHQRPTLRRLRPEEMFETWEDDL-NGIHIVAFAEKSDPDGYEFLEILKQVARDNT DNPDL-SILWIDPDDFPLLVAYWEKTFKIDLFRP-QIGVVNVTDADSVWMEIPDDDDLPTA EELEDWIEDVLSGKINTEDDDEDDDDDD-NSDEEDNDDSDDDDE corresponding to amino acids 179-399 of CAQ2_HUMAN (SEQ ID NO:349), which also corresponds to amino acids 101-321 of N56180_P6 (SEQ ID NO:288), wherein said first, second, third and fourth amino acid sequences are contiguous and in a sequential order.

2. An isolated polypeptide encoding for a head of N56180_P6 (SEQ ID NO:288), comprising a polypeptide being at least 70%, optionally at least about 80%, preferably at least about 85%, more preferably at least about 90% and most preferably at least about 95% homologous to the sequence NETEAEQSYV (SEQ ID NO:402) of N56180_P6 (SEQ ID NO:288).

3. An isolated polypeptide encoding for an edge portion of N56180_P6 (SEQ ID NO:288), comprising a polypeptide having a length "n", wherein "n" is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LDY having a structure as follows (numbering according to N56180_P6 (SEQ ID NO:288)): a sequence starting from any of amino acid numbers 99−x to 99; and ending at any of amino acid numbers 101+((n−2)−x), in which x varies from 0 to n−2.

Variant protein N56180_P6 (SEQ ID NO:288) also has the following non-silent SNPs (Single Nucleotide Polymorphisms) as listed in Table 13, (given according to their position(s) on the amino acid sequence, with the alternative amino acid(s) listed; the last column indicates whether the SNP is known or not; the presence of known SNPs in variant protein N56180_P6 (SEQ ID NO:288) sequence provides support for the deduced sequence of this variant protein according to the present invention).

TABLE 13

Amino acid mutations

| SNP position(s) on amino acid sequence | Alternative amino acid(s) | Previously known SNP? |
| --- | --- | --- |
| 151 | N -> | No |
| 59 | T -> A | Yes |
| 69 | V -> M | Yes |

Variant protein N56180_P6 (SEQ ID NO:288) is encoded by the following transcript(s): N56180_T5 (SEQ ID NO:8), for which the sequence(s) is/are given at the end of the application. The coding portion of transcript N56180_T5 (SEQ ID NO:8) is shown in bold; this coding portion starts at position 1 and ends at position 964. The transcript also has the following SNPs as listed in Table 14 (given according to their position on the nucleotide sequence, with the alternative nucleic acid listed; the last column indicates whether the SNP is known or not; the presence of known SNPs in variant protein N56180_P6 (SEQ ID NO:288) sequence provides support for the deduced sequence of this variant protein according to the present invention).

TABLE 14

Nucleic acid SNPs

| SNP position on nucleotide sequence | Alternative nucleic acid | Previously known SNP? |
| --- | --- | --- |
| 176 | A -> G | Yes |
| 206 | G -> A | Yes |
| 452 | A -> | No |
| 952 | C -> T | Yes |
| 1449 | C -> T | Yes |
| 1599 | C -> G | Yes |
| 1720 | G -> T | No |
| 1920 | A -> C | No |

TABLE 14-continued

Nucleic acid SNPs

| SNP position on nucleotide sequence | Alternative nucleic acid | Previously known SNP? |
|---|---|---|
| 1976 | A -> | Yes |
| 2069 | A -> T | Yes |

Variant protein N56180_P7 (SEQ ID NO:289) according to the present invention has an amino acid sequence as given at the end of the application; it is encoded by transcript(s) N56180_T6 (SEQ ID NO:9). An alignment is given to the known protein (Calsequestrin, cardiac muscle isoform precursor (SEQ ID NO:349)) at the end of the application. One or more alignments to one or more previously published protein sequences are given at the end of the application. A brief description of the relationship of the variant protein according to the present invention to each such aligned protein is as follows:

Comparison report between N56180_P7 (SEQ ID NO:289) and CAQ2_HUMAN (SEQ ID NO:349):

1. An isolated chimeric polypeptide encoding for N56180_P7 (SEQ ID NO:289), comprising a first amino acid sequence being at least 70%, optionally at least 80%, preferably at least 85%, more preferably at least 90% and most preferably at least 95% homologous to a polypeptide having the sequence MSSWLSAGSPSSLSV (SEQ ID NO:403) corresponding to amino acids 1-15 of N56180_P7 (SEQ ID NO:289), and a second amino acid sequence being at least 90% homologous to VAKKLSLKMNEVD-FYEPFMDEPIAIPNKPYTEEELVEFVKE-HQRPTLRRLRPEEMFETW EDDLNGIHIVAFAEKSDP-DGYEFLEILKQVARDNTDNPDLSILWIDPDDFPLLVAYWEKT FKIDLFRPQIGVVNVTDADSVWMEIPD-DDDLPTAEELEDWIEDVLSGKINTEDDDEDDD DDD-NSDEEDNDDSDDDDDE corresponding to amino acids 203-399 of CAQ2_HUMAN (SEQ ID NO:349), which also corresponds to amino acids 16-212 of N56180_P7 (SEQ ID NO:289), wherein said first and second amino acid sequences are contiguous and in a sequential order.

2. An isolated polypeptide encoding for a head of N56180_P7 (SEQ ID NO:289), comprising a polypeptide being at least 70%, optionally at least about 80%, preferably at least about 85%, more preferably at least about 90% and most preferably at least about 95% homologous to the sequence MSSWLSAGSPSSLSV (SEQ ID NO:403) of N56180_P7 (SEQ ID NO:289).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein N56180_P7 (SEQ ID NO:289) also has the following non-silent SNPs (Single Nucleotide Polymorphisms) as listed in Table 15, (given according to their position(s) on the amino acid sequence, with the alternative amino acid(s) listed; the last column indicates whether the SNP is known or not; the presence of known SNPs in variant protein N56180_P7 (SEQ ID NO:289) sequence provides support for the deduced sequence of this variant protein according to the present invention).

TABLE 15

Amino acid mutations

| SNP position(s) on amino acid sequence | Alternative amino acid(s) | Previously known SNP? |
|---|---|---|
| 42 | N -> | No |

Variant protein N56180_P7 (SEQ ID NO:289) is encoded by the following transcript(s): N56180_T6 (SEQ ID NO:9), for which the sequence(s) is/are given at the end of the application. The coding portion of transcript N56180_T6 (SEQ ID NO:9) is shown in bold; this coding portion starts at position 71 and ends at position 706. The transcript also has the following SNPs as listed in Table 16 (given according to their position on the nucleotide sequence, with the alternative nucleic acid listed; the last column indicates whether the SNP is known or not; the presence of known SNPs in variant protein N56180_P7 (SEQ ID NO:289) sequence provides support for the deduced sequence of this variant protein according to the present invention).

TABLE 16

Nucleic acid SNPs

| SNP position on nucleotide sequence | Alternative nucleic acid | Previously known SNP? |
|---|---|---|
| 194 | A -> | No |
| 694 | C -> T | Yes |
| 1191 | C -> T | Yes |
| 1341 | C -> G | Yes |
| 1462 | G -> T | No |
| 1662 | A -> C | No |
| 1718 | A -> | Yes |
| 1811 | A -> T | Yes |

Variant protein N56180_P8 (SEQ ID NO:290) according to the present invention has an amino acid sequence as given at the end of the application; it is encoded by transcript(s) N56180_T7 (SEQ ID NO:10). An alignment is given to the known protein (Calsequestrin, cardiac muscle isoform precursor (SEQ ID NO:349)) at the end of the application. One or more alignments to one or more previously published protein sequences are given at the end of the application. A brief description of the relationship of the variant protein according to the present invention to each such aligned protein is as follows:

Comparison report between N56180_P8 (SEQ ID NO:290) and CAQ2_HUMAN (SEQ ID NO:349):

1. An isolated chimeric polypeptide encoding for N56180_P8 (SEQ ID NO:290), comprising a first amino acid sequence being at least 70%, optionally at least 80%, preferably at least 85%, more preferably at least 90% and most preferably at least 95% homologous to a polypeptide having the sequence MCRGYSTLLNPVS (SEQ ID NO:404) corresponding to amino acids 1-13 of N56180_P8 (SEQ ID NO:290), and a second amino acid sequence being at least 90% homologous to DGYEFLEILKQVARDNTD-NPDLSILWIDPDDFPLLVAYWEKT-FKIDLFRPQIGVVNVTD ADSVWMEIPDDDDLP-TAEELEDWIEDVLSGKINTEDDDEDDDDDNSDEED NDDSDD DDDE corresponding to amino acids 280-399 of CAQ2_HUMAN (SEQ ID NO:349), which also corresponds to amino acids 14-133 of N56180_P8 (SEQ ID NO:290), wherein said first and second amino acid sequences are contiguous and in a sequential order.

2. An isolated polypeptide encoding for a head of N56180_P8 (SEQ ID NO:290), comprising a polypeptide being at least 70%, optionally at least about 80%, preferably at least about 85%, more preferably at least about 90% and most preferably at least about 95% homologous to the sequence MCRGYSTLLNPVS (SEQ ID NO:404) of N56180_P8 (SEQ ID NO:290).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein N56180_P8 (SEQ ID NO:290) is encoded by the following transcript(s): N56180_T7 (SEQ ID NO:10), for which the sequence(s) is/are given at the end of the application. The coding portion of transcript N56180_T7 (SEQ ID NO:10) is shown in bold; this coding portion starts at position 97 and ends at position 495. The transcript also has the following SNPs as listed in Table 17 (given according to their position on the nucleotide sequence, with the alternative nucleic acid listed; the last column indicates whether the SNP is known or not; the presence of known SNPs in variant protein N56180_P8 (SEQ ID NO:290) sequence provides support for the deduced sequence of this variant protein according to the present invention).

TABLE 17

Nucleic acid SNPs

| SNP position on nucleotide sequence | Alternative nucleic acid | Previously known SNP? |
|---|---|---|
| 483 | C -> T | Yes |
| 980 | C -> T | Yes |
| 1130 | C -> G | Yes |
| 1251 | G -> T | No |
| 1451 | A -> C | No |
| 1507 | A -> | Yes |
| 1600 | A -> T | Yes |

Variant protein N56180_P9 (SEQ ID NO:291) according to the present invention has an amino acid sequence as given at the end of the application; it is encoded by transcript(s) N56180_T8 (SEQ ID NO:11). An alignment is given to the known protein (Calsequestrin, cardiac muscle isoform precursor (SEQ ID NO:349)) at the end of the application. One or more alignments to one or more previously published protein sequences are given at the end of the application. A brief description of the relationship of the variant protein according to the present invention to each such aligned protein is as follows:

Comparison report between N56180_P9 (SEQ ID NO:291) and CAQ2_HUMAN (SEQ ID NO:349):

1. An isolated chimeric polypeptide encoding for N56180_P9 (SEQ ID NO:291), comprising a first amino acid sequence being at least 90% homologous to MKRTH-LFIVGIYFLSSCRAEEGLNFP-TYDGKDRVVSLSEKNFKQVLKKYDLLCLYYHEP VSSDKVTQKQFQLKEIVLELVAQVLEH-KAIGFVMVDAKKEAKLAKKLGFDEEGSLYIL KGDRTIEFDGEFAADVLVEFLLDLIED-PVEIISSKLEVQAFERIEDYIKLIGFFKSEDSEYY KAF-EEAAEHFQPYIKFFATFDKGVAKKLSLK-MNEVDFYEPFMDEPIAIPNKPYTEEELVE FVKEHQR corresponding to amino acids 1-246 of CAQ2_HUMAN (SEQ ID NO:349), which also corresponds to amino acids 1-246 of N56180_P9 (SEQ ID NO:291), and a second amino acid sequence being at least 70%, optionally at least 80%, preferably at least 85%, more preferably at least 90% and most preferably at least 95% homologous to a polypeptide having the sequence SRNWTQ (SEQ ID NO:405) corresponding to amino acids 247-252 of N56180_P9 (SEQ ID NO:291), wherein said first and second amino acid sequences are contiguous and in a sequential order.

2. An isolated polypeptide encoding for a tail of N56180_P9 (SEQ ID NO:291), comprising a polypeptide being at least 70%, optionally at least about 80%, preferably at least about 85%, more preferably at least about 90% and most preferably at least about 95% homologous to the sequence SRNWTQ (SEQ ID NO:405) in N56180_P9 (SEQ ID NO:291).

The location of the variant protein was determined according to results from a number of different software programs and analyses, including analyses from SignalP and other specialized programs. The variant protein is believed to be located as follows with regard to the cell: secreted or localized in the sarcoplasmic reticulum's terminal cisternae luminal spaces of cardiac and slow skeletal muscle cells like the WT protein. The protein localization is believed to be secreted because both signal-peptide prediction programs predict that this protein has a signal peptide, and neither trans-membrane region prediction program predicts that this protein has a trans-membrane region.

Variant protein N56180_P9 (SEQ ID NO:291) also has the following non-silent SNPs (Single Nucleotide Polymorphisms) as listed in Table 18, (given according to their position(s) on the amino acid sequence, with the alternative amino acid(s) listed; the last column indicates whether the SNP is known or not; the presence of known SNPs in variant protein N56180_P9 (SEQ ID NO:291) sequence provides support for the deduced sequence of this variant protein according to the present invention).

TABLE 18

Amino acid mutations

| SNP position(s) on amino acid sequence | Alternative amino acid(s) | Previously known SNP? |
|---|---|---|
| 229 | N -> | No |
| 66 | T -> A | Yes |
| 76 | V -> M | Yes |

Variant protein N56180_P9 (SEQ ID NO:291) is encoded by the following transcript(s): N56180_T8 (SEQ ID NO:11), for which the sequence(s) is/are given at the end of the application. The coding portion of transcript N56180_T8 (SEQ ID NO:11) is shown in bold; this coding portion starts at position 242 and ends at position 997. The transcript also has the following SNPs as listed in Table 19 (given according to their position on the nucleotide sequence, with the alternative nucleic acid listed; the last column indicates whether the SNP is known or not; the presence of known SNPs in variant protein N56180_P9 (SEQ ID NO:291) sequence provides support for the deduced sequence of this variant protein according to the present invention).

TABLE 19

Nucleic acid SNPs

| SNP position on nucleotide sequence | Alternative nucleic acid | Previously known SNP? |
|---|---|---|
| 74 | T -> | No |
| 105 | T -> C | Yes |
| 1153 | G -> A | Yes |
| 1170 | G -> A | Yes |
| 206 | G -> A | Yes |
| 221 | G -> A | Yes |
| 228 | A -> C | Yes |
| 437 | A -> G | Yes |
| 467 | G -> A | Yes |
| 926 | A -> | No |
| 1095 | A -> | No |
| 1095 | A -> T | No |

As noted above, cluster N56180 features 22 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster N56180_node_2 (SEQ ID NO:73) according to the present invention is supported by 36 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7) and N56180_T8 (SEQ ID NO:11). Table 20 below describes the starting and ending position of this segment on each transcript.

TABLE 20

Segment location on transcripts

| Transcript name | Segment starting position | Segment ending position |
|---|---|---|
| N56180_T1 (SEQ ID NO: 5) | 1 | 237 |
| N56180_T3 (SEQ ID NO: 6) | 1 | 237 |
| N56180_T4 (SEQ ID NO: 7) | 1 | 237 |
| N56180_T8 (SEQ ID NO: 11) | 1 | 237 |

Segment cluster N56180_node_20 (SEQ ID NO:74) according to the present invention is supported by 30 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7), N56180_T5 (SEQ ID NO:8), N56180_T6 (SEQ ID NO:9) and N56180_T8 (SEQ ID NO:11). Table 21 below describes the starting and ending position of this segment on each transcript.

TABLE 21

Segment location on transcripts

| Transcript name | Segment starting position | Segment ending position |
|---|---|---|
| N56180_T1 (SEQ ID NO: 5) | 943 | 1073 |
| N56180_T3 (SEQ ID NO: 6) | 989 | 1119 |
| N56180_T4 (SEQ ID NO: 7) | 662 | 792 |
| N56180_T5 (SEQ ID NO: 8) | 374 | 504 |

TABLE 21-continued

Segment location on transcripts

| Transcript name | Segment starting position | Segment ending position |
|---|---|---|
| N56180_T6 (SEQ ID NO: 9) | 116 | 246 |
| N56180_T8 (SEQ ID NO: 11) | 848 | 978 |

Segment cluster N56180_node_22 (SEQ ID NO:75) according to the present invention is supported by 3 libraries. The number of libraries was determined as previously described. This segment can be found in the following transcript(s): N56180_T8 (SEQ ID NO:11). Table 22 below describes the starting and ending position of this segment on each transcript.

TABLE 22

Segment location on transcripts

| Transcript name | Segment starting position | Segment ending position |
|---|---|---|
| N56180_T8 (SEQ ID NO: 11) | 979 | 1259 |

Segment cluster N56180_node_28 (SEQ ID NO:76) according to the present invention is supported by 1 libraries. The number of libraries was determined as previously described. This segment can be found in the following transcript(s): N56180_T7 (SEQ ID NO:10). Table 23 below describes the starting and ending position of this segment on each transcript.

TABLE 23

Segment location on transcripts

| Transcript name | Segment starting position | Segment ending position |
|---|---|---|
| N56180_T7 (SEQ ID NO: 10) | 1 | 136 |

Segment cluster N56180_node_34 (SEQ ID NO:77) according to the present invention is supported by 37 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7), N56180_T5 (SEQ ID NO:8), N56180_T6 (SEQ ID NO:9) and N56180_T7 (SEQ ID NO:10). Table 24 below describes the starting and ending position of this segment on each transcript.

TABLE 24

Segment location on transcripts

| Transcript name | Segment starting position | Segment ending position |
|---|---|---|
| N56180_T1 (SEQ ID NO: 5) | 1397 | 1644 |
| N56180_T3 (SEQ ID NO: 6) | 1443 | 1690 |
| N56180_T4 (SEQ ID NO: 7) | 1116 | 1363 |
| N56180_T5 (SEQ ID NO: 8) | 828 | 1075 |
| N56180_T6 (SEQ ID NO: 9) | 570 | 817 |
| N56180_T7 (SEQ ID NO: 10) | 359 | 606 |

Segment cluster N56180_node_36 (SEQ ID NO:78) according to the present invention is supported by 77 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7), N56180_T5 (SEQ ID NO:8), N56180_T6 (SEQ ID NO:9) and N56180_T7 (SEQ ID NO:10). Table 25 below describes the starting and ending position of this segment on each transcript.

TABLE 25

Segment location on transcripts

| Transcript name | Segment starting position | Segment ending position |
|---|---|---|
| N56180_T1 (SEQ ID NO: 5) | 1655 | 2778 |
| N56180_T3 (SEQ ID NO: 6) | 1701 | 2824 |
| N56180_T4 (SEQ ID NO: 7) | 1374 | 2497 |
| N56180_T5 (SEQ ID NO: 8) | 1086 | 2209 |
| N56180_T6 (SEQ ID NO: 9) | 828 | 1951 |
| N56180_T7 (SEQ ID NO: 10) | 617 | 1740 |

Segment cluster N56180_node_4 (SEQ ID NO:79) according to the present invention is supported by 34 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7), N56180_T5 (SEQ ID NO:8) and N56180_T8 (SEQ ID NO:11). Table 26 below describes the starting and ending position of this segment on each transcript.

TABLE 26

Segment location on transcripts

| Transcript name | Segment starting position | Segment ending position |
|---|---|---|
| N56180_T1 (SEQ ID NO: 5) | 295 | 475 |
| N56180_T3 (SEQ ID NO: 6) | 295 | 475 |
| N56180_T4 (SEQ ID NO: 7) | 295 | 475 |
| N56180_T5 (SEQ ID NO: 8) | 34 | 214 |
| N56180_T8 (SEQ ID NO: 11) | 295 | 475 |

Segment cluster N56180_node_6 (SEQ ID NO:80) according to the present invention is supported by 1 libraries. The number of libraries was determined as previously described. This segment can be found in the following transcript(s): N56180_T3 (SEQ ID NO:6). Table 27 below describes the starting and ending position of this segment on each transcript.

TABLE 27

Segment location on transcripts

| Transcript name | Segment starting position | Segment ending position |
|---|---|---|
| N56180_T3 (SEQ ID NO: 6) | 476 | 616 |

According to an optional embodiment of the present invention, short segments related to the above cluster are also provided. These segments are up to about 120 bp in length, and so are included in a separate description.

Segment cluster N56180_node_0 (SEQ ID NO:81) according to the present invention is supported by 1 libraries. The number of libraries was determined as previously described. This segment can be found in the following transcript(s): N56180_T5 (SEQ ID NO:8). Table 28 below describes the starting and ending position of this segment on each transcript.

TABLE 28

Segment location on transcripts

| Transcript name | Segment starting position | Segment ending position |
|---|---|---|
| N56180_T5 (SEQ ID NO: 8) | 1 | 33 |

Segment cluster N56180_node_10 (SEQ ID NO:82) according to the present invention is supported by 24 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7) and N56180_T8 (SEQ ID NO:11). Table 29 below describes the starting and ending position of this segment on each transcript.

TABLE 29

Segment location on transcripts

| Transcript name | Segment starting position | Segment ending position |
|---|---|---|
| N56180_T1 (SEQ ID NO: 5) | 561 | 661 |
| N56180_T3 (SEQ ID NO: 6) | 702 | 802 |
| N56180_T4 (SEQ ID NO: 7) | 561 | 661 |
| N56180_T8 (SEQ ID NO: 11) | 561 | 661 |

Segment cluster N56180_node_12 (SEQ ID NO:83) according to the present invention is supported by 27 libraries. The number of libraries was determined as previously described. This segment can be found in the following transcript(s): N56180_T1 (SEQ ID NO:5), N56180_T3 (SEQ ID NO:6) and N56180_T8 (SEQ ID NO:11). Table 30 below describes the starting and ending position of this segment on each transcript.

TABLE 30

Segment location on transcripts

| Transcript name | Segment starting position | Segment ending position |
|---|---|---|
| N56180_T1 (SEQ ID NO: 5) | 662 | 773 |
| N56180_T3 (SEQ ID NO: 6) | 803 | 914 |
| N56180_T8 (SEQ ID NO: 11) | 662 | 773 |

Segment cluster N56180_node_14 (SEQ ID NO:84) according to the present invention is supported by 26 libraries. The number of libraries was determined as previously described. This segment can be found in the following transcript(s): N56180_T1 (SEQ ID NO:5), N56180_T3 (SEQ ID NO:6), N56180_T5 (SEQ ID NO:8) and N56180_T8 (SEQ ID NO:11). Table 31 below describes the starting and ending position of this segment on each transcript.

TABLE 31

Segment location on transcripts

| Transcript name | Segment starting position | Segment ending position |
|---|---|---|
| N56180_T1 (SEQ ID NO: 5) | 774 | 847 |
| N56180_T3 (SEQ ID NO: 6) | 915 | 988 |
| N56180_T5 (SEQ ID NO: 8) | 300 | 373 |
| N56180_T8 (SEQ ID NO: 11) | 774 | 847 |

Segment cluster N56180_node_16 (SEQ ID NO:85) according to the present invention is supported by 1 libraries. The number of libraries was determined as previously described. This segment can be found in the following transcript(s): N56180_T1 (SEQ ID NO:5). Table 32 below describes the starting and ending position of this segment on each transcript.

TABLE 32

Segment location on transcripts

| Transcript name | Segment starting position | Segment ending position |
|---|---|---|
| N56180_T1 (SEQ ID NO: 5) | 848 | 942 |

Segment cluster N56180_node_18 (SEQ ID NO:86) according to the present invention is supported by 1 libraries. The number of libraries was determined as previously described. This segment can be found in the following transcript(s): N56180_T6 (SEQ ID NO:9). Table 33 below describes the starting and ending position of this segment on each transcript.

TABLE 33

Segment location on transcripts

| Transcript name | Segment starting position | Segment ending position |
|---|---|---|
| N56180_T6 (SEQ ID NO: 9) | 1 | 115 |

Segment cluster N56180_node_24 (SEQ ID NO:87) according to the present invention is supported by 25 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7), N56180_T5 (SEQ ID NO:8) and N56180_T6 (SEQ ID NO:9). Table 34 below describes the starting and ending position of this segment on each transcript.

TABLE 34

Segment location on transcripts

| Transcript name | Segment starting position | Segment ending position |
|---|---|---|
| N56180_T1 (SEQ ID NO: 5) | 1074 | 1119 |
| N56180_T3 (SEQ ID NO: 6) | 1120 | 1165 |
| N56180_T4 (SEQ ID NO: 7) | 793 | 838 |
| N56180_T5 (SEQ ID NO: 8) | 505 | 550 |
| N56180_T6 (SEQ ID NO: 9) | 247 | 292 |

Segment cluster N56180_node_26 (SEQ ID NO:88) according to the present invention is supported by 28 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7), N56180_T5 (SEQ ID NO:8) and N56180_T6 (SEQ ID NO:9). Table 35 below describes the starting and ending position of this segment on each transcript.

TABLE 35

Segment location on transcripts

| Transcript name | Segment starting position | Segment ending position |
|---|---|---|
| N56180_T1 (SEQ ID NO: 5) | 1120 | 1174 |
| N56180_T3 (SEQ ID NO: 6) | 1166 | 1220 |
| N56180_T4 (SEQ ID NO: 7) | 839 | 893 |
| N56180_T5 (SEQ ID NO: 8) | 551 | 605 |
| N56180_T6 (SEQ ID NO: 9) | 293 | 347 |

Segment cluster N56180_node_29 (SEQ ID NO:89) according to the present invention is supported by 32 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7), N56180_T5 (SEQ ID NO:8), N56180_T6 (SEQ ID NO:9) and N56180_T7 (SEQ ID NO:10). Table 36 below describes the starting and ending position of this segment on each transcript.

TABLE 36

Segment location on transcripts

| Transcript name | Segment starting position | Segment ending position |
|---|---|---|
| N56180_T1 (SEQ ID NO: 5) | 1175 | 1275 |
| N56180_T3 (SEQ ID NO: 6) | 1221 | 1321 |
| N56180_T4 (SEQ ID NO: 7) | 894 | 994 |
| N56180_T5 (SEQ ID NO: 8) | 606 | 706 |
| N56180_T6 (SEQ ID NO: 9) | 348 | 448 |
| N56180_T7 (SEQ ID NO: 10) | 137 | 237 |

Segment cluster N56180_node_3 (SEQ ID NO:90) according to the present invention is supported by 36 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7) and N56180_T8 (SEQ ID NO:11). Table 37 below describes the starting and ending position of this segment on each transcript.

TABLE 37

Segment location on transcripts

| Transcript name | Segment starting position | Segment ending position |
|---|---|---|
| N56180_T1 (SEQ ID NO: 5) | 238 | 294 |
| N56180_T3 (SEQ ID NO: 6) | 238 | 294 |
| N56180_T4 (SEQ ID NO: 7) | 238 | 294 |
| N56180_T8 (SEQ ID NO: 11) | 238 | 294 |

Segment cluster N56180_node_31 (SEQ ID NO:91) according to the present invention is supported by 30 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7), N56180_T5 (SEQ ID NO:8), N56180_T6 (SEQ ID NO:9) and N56180_T7 (SEQ ID NO:10). Table 38 below describes the starting and ending position of this segment on each transcript.

TABLE 38

Segment location on transcripts

| Transcript name | Segment starting position | Segment ending position |
|---|---|---|
| N56180_T1 (SEQ ID NO: 5) | 1276 | 1350 |
| N56180_T3 (SEQ ID NO: 6) | 1322 | 1396 |
| N56180_T4 (SEQ ID NO: 7) | 995 | 1069 |
| N56180_T5 (SEQ ID NO: 8) | 707 | 781 |
| N56180_T6 (SEQ ID NO: 9) | 449 | 523 |
| N56180_T7 (SEQ ID NO: 10) | 238 | 312 |

Segment cluster N56180_node_33 (SEQ ID NO:92) according to the present invention is supported by 30 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7), N56180_T5 (SEQ ID NO:8), N56180_T6 (SEQ ID NO:9) and N56180_T7 (SEQ ID NO:10). Table 39 below describes the starting and ending position of this segment on each transcript.

TABLE 39

Segment location on transcripts

| Transcript name | Segment starting position | Segment ending position |
|---|---|---|
| N56180_T1 (SEQ ID NO: 5) | 1351 | 1396 |
| N56180_T3 (SEQ ID NO: 6) | 1397 | 1442 |
| N56180_T4 (SEQ ID NO: 7) | 1070 | 1115 |
| N56180_T5 (SEQ ID NO: 8) | 782 | 827 |
| N56180_T6 (SEQ ID NO: 9) | 524 | 569 |
| N56180_T7 (SEQ ID NO: 10) | 313 | 358 |

Segment cluster N56180_node_35 (SEQ ID NO:93) according to the present invention can be found in the following transcript(s): N56180_T1 (SEQ ID NO:5), N56180_T3 (SEQ ID NO:6), N56180_T4 (SEQ ID NO:7), N56180_T5 (SEQ ID NO:8), N56180_T6 (SEQ ID NO:9) and N56180_T7 (SEQ ID NO:10). Table 40 below describes the starting and ending position of this segment on each transcript.

TABLE 40

Segment location on transcripts

| Transcript name | Segment starting position | Segment ending position |
|---|---|---|
| N56180_T1 (SEQ ID NO: 5) | 1645 | 1654 |
| N56180_T3 (SEQ ID NO: 6) | 1691 | 1700 |
| N56180_T4 (SEQ ID NO: 7) | 1364 | 1373 |
| N56180_T5 (SEQ ID NO: 8) | 1076 | 1085 |
| N56180_T6 (SEQ ID NO: 9) | 818 | 827 |
| N56180_T7 (SEQ ID NO: 10) | 607 | 616 |

Segment cluster N56180_node_8 (SEQ ID NO:94) according to the present invention is supported by 25 libraries. The number of libraries was determined as previously described. This segment can be found in the following transcript(s): N56180_T1 (SEQ ID NO:5), N56180_T3 (SEQ ID NO:6), N56180_T4 (SEQ ID NO:7), N56180_T5 (SEQ ID NO:8) and N56180_T8 (SEQ ID NO:11). Table 41 below describes the starting and ending position of this segment on each transcript.

TABLE 41

Segment location on transcripts

| Transcript name | Segment starting position | Segment ending position |
|---|---|---|
| N56180_T1 (SEQ ID NO: 5) | 476 | 560 |
| N56180_T3 (SEQ ID NO: 6) | 617 | 701 |
| N56180_T4 (SEQ ID NO: 7) | 476 | 560 |
| N56180_T5 (SEQ ID NO: 8) | 215 | 299 |
| N56180_T8 (SEQ ID NO: 11) | 476 | 560 |

Variant Protein Alignment to the Previously Known Protein:
Sequence name: /tmp/QH4bp76Ojk/sAp7DyaTKD: CAQ2_HUMAN (SEQ ID NO:349)
Sequence documentation:
Alignment of: N56180_P2 (SEQ ID NO:285) x CAQ2_HUMAN (SEQ ID NO:349).

| Alignment segment 1/1: | | | |
|---|---|---|---|
| Quality: | 1955.00 | Escore: | 0 |
| Matching length: | 203 | Total length: | 203 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MKRTHLFIVGIYFLSSCRAEEGLNFPTYDGKDRVVSLSEKNFKQVLKKYD   50
     ||||||||||||||||||||||||||||||||||||||||||||||||||
  1  MKRTHLFIVGIYFLSSCRAEEGLNFPTYDGKDRVVSLSEKNFKQVLKKYD   50

51  LLCLYYHEPVSSDKVTQKQFQLKEIVLELVAQVLEHKAIGFVMVDAKKEA  100
     ||||||||||||||||||||||||||||||||||||||||||||||||||
 51  LLCLYYHEPVSSDKVTQKQFQLKEIVLELVAQVLEHKAIGFVMVDAKKEA  100

101  KLAKKLGFDEEGSLYILKGDRTIEFDGEFAADVLVEFLLDLIEDPVEIIS  150
     ||||||||||||||||||||||||||||||||||||||||||||||||||
101  KLAKKLGFDEEGSLYILKGDRTIEFDGEFAADVLVEFLLDLIEDPVEIIS  150
```

-continued

```
151 SKLEVQAFERIEDYIKLIGFFKSEDSEYYKAFEEAAEHFQPYIKFFATFD  200
    ||||||||||||||||||||||||||||||||||||||||||||||||||
151 SKLEVQAFERIEDYIKLIGFFKSEDSEYYKAFEEAAEHFQPYIKFFATFD  200
201 KGV  203
    |||
201 KGV  203
```

Sequence name: /tmp/VtcMdCiEuz/FlmsgLbcq4: CAQ2_HUMAN (SEQ ID NO:349)
Sequence documentation:
Alignment of: N56180_P4 (SEQ ID NO:286) x CAQ2_HUMAN (SEQ ID NO:349).

| Alignment segment 1/1: | | | |
|---|---|---|---|
| Quality: | 3806.00 | Escore: | 0 |
| Matching length: | 399 | Total length: | 446 |
| Matching Percent Similarity: | 100.00 | Matching Percent Identity: | 100.00 |
| Total Percent Similarity: | 89.46 | Total Percent Identity: | 89.46 |
| Gaps: | 1 | | |

Alignment:

Sequence name: /tmp/lRixkfCRfD/JDL7BwYPJs: CAQ2_HUMAN (SEQ ID NO:349)
Sequence documentation:
Alignment of: N56180_P5 (SEQ ID NO:287) x CAQ2_HUMAN (SEQ ID NO:349).

| Alignment segment 1/1: | | | |
|---|---|---|---|
| Quality: | 3202.00 | Escore: | 0 |
| Matching length: | 337 | Total length: | 399 |
| Matching Percent Similarity: | 100.00 | Matching Percent Identity: | 100.00 |
| Total Percent Similarity: | 84.46 | Total Percent Identity: | 84.46 |
| Gaps: | 1 | | |

```
  1 MKRTHLFIVGIYFLSSCRAEEGLNFPTYDGKDRVVSLSEKNFKQVLKKYD   50
    ||||||||||||||||||||||||||||||||||||||||||||||||||
  1 MKRTHLFIVGIYFLSSCRAEEGLNFPTYDGKDRVVSLSEKNFKQVLKKYD   50

51 LLCLYYHEPVSSDKVTQKQFQLKEIVLEHWQISQWWLHFQTPREEGKMKL  100
    |||||||||||||||||||||||||||
 51 LLCLYYHEPVSSDKVTQKQFQLKEIVLE......................   78

101 LELSESADGAAWKRWGGNSNTHRIQLVAQVLEHKAIGFVMVDAKKEAKLA  150
                          |||||||||||||||||||||||||
 79 .......................LVAQVLEHKAIGFVMVDAKKEAKLA  103

151 KKLGFDEEGSLYILKGDRTIEFDGEFAADVLVEFLLDLIEDPVEIISSKL  200
    ||||||||||||||||||||||||||||||||||||||||||||||||||
104 KKLGFDEEGSLYILKGDRTIEFDGEFAADVLVEFLLDLIEDPVEIISSKL  153

201 EVQAFERIEDYIKLIGFFKSEDSEYYKAFEEAAEHFQPYIKFFATFDKGV  250
    ||||||||||||||||||||||||||||||||||||||||||||||||||
154 EVQAFERIEDYIKLIGFFKSEDSEYYKAFEEAAEHFQPYIKFFATFDKGV  203

251 AKKLSLKMNEVDFYEPFMDEPIAIPNKPYTEEELVEFVKEHQRPTLRRLR  300
    ||||||||||||||||||||||||||||||||||||||||||||||||||
204 AKKLSLKMNEVDFYEPFMDEPIAIPNKPYTEEELVEFVKEHQRPTLRRLR  253

301 PEEMFETWEDDLNGIHIVAFAEKSDPDGYEFLEILKQVARDNTDNPDLSI  350
    ||||||||||||||||||||||||||||||||||||||||||||||||||
254 PEEMFETWEDDLNGIHIVAFAEKSDPDGYEFLEILKQVARDNTDNPDLSI  303

351 LWIDPDDFPLLVAYWEKTFKIDLFRPQIGVVNVTDADSVWMEIPDDDDLP  400
    ||||||||||||||||||||||||||||||||||||||||||||||||||
304 LWIDPDDFPLLVAYWEKTFKIDLFRPQIGVVNVTDADSVWMEIPDDDDLP  353

401 TAEELEDWIEDVLSGKINTEDDDEDDDDDNSDEEDNDDSDDDDDE       446
    |||||||||||||||||||||||||||||||||||||||||||||
354 TAEELEDWIEDVLSGKINTEDDDEDDDDDNSDEEDNDDSDDDDDE       399
```

Alignment:

```
  1 MKRTHLFIVGIYFLSSCRAEEGLNFPTYDGKDRVVSLSEKNFKQVLKKYD   50
    ||||||||||||||||||||||||||||||||||||||||||||||||||
  1 MKRTHLFIVGIYFLSSCRAEEGLNFPTYDGKDRVVSLSEKNFKQVLKKYD   50

51 LLCLYYHEPVSSDKVTQKQFQLKEIVLELVAQVLEHKAIGFVMVDAKKEA  100
    ||||||||||||||||||||||||||||||||||||||||||||||||||
 51 LLCLYYHEPVSSDKVTQKQFQLKEIVLELVAQVLEHKAIGFVMVDAKKEA  100

101 KLAKKLGFDEEGSLYILKGDRTIEFDGEFAADVLVEFLLD..........  140
    |||||||||||||||||||||||||||||||||||||||
101 KLAKKLGFDEEGSLYILKGDRTIEFDGEFAADVLVEFLLDLIEDPVEIIS  150

140 ..................................................  140
151 SKLEVQAFERIEDYIKLIGFFKSEDSEYYKAFEEAAEHFQPYIKFFATFD  200

141 ..VAKKLSLKMNEVDFYEPFMDEPIAIPNKPYTEEELVEFVKEHQRPTLR  188
      |||||||||||||||||||||||||||||||||||||||||||||||
201 KGVAKKLSLKMNEVDFYEPFMDEPIAIPNKPYTEEELVEFVKEHQRPTLR  250

189 RLRPEEMFETWEDDLNGIHIVAFAEKSDPDGYEFLEILKQVARDNTDNPD  238
    ||||||||||||||||||||||||||||||||||||||||||||||||||
251 RLRPEEMFETWEDDLNGIHIVAFAEKSDPDGYEFLEILKQVARDNTDNPD  300

239 LSILWIDPDDFPLLVAYWEKTFKIDLFRPQIGVVNVTDADSVWMEIPDDD  288
    ||||||||||||||||||||||||||||||||||||||||||||||||||
301 LSILWIDPDDFPLLVAYWEKTFKIDLFRPQIGVVNVTDADSVWMEIPDDD  350

289 DLPTAEELEDWIEDVLSGKINTEDDDEDDDDDDNSDEEDNDDSDDDDDE   337
    ||||||||||||||||||||||||||||||||||||||||||||||||
351 DLPTAEELEDWIEDVLSGKINTEDDDEDDDDDDNSDEEDNDDSDDDDDE   399
```

Sequence name: /tmp/rs5xPc26iA/X1zfpEDF7: CAQ2_HUMAN (SEQ ID NO:349)

Sequence documentation:

Alignment of: N56180_P6 (SEQ ID NO:288) x CAQ2_HUMAN (SEQ ID NO:349).

Alignment segment 1/1:

| Quality: | 2955.00 | Escore: | 0 |
|---|---|---|---|
| Matching length: | 314 | Total length: | 385 |

Alignment segment 1/1:

| Matching Percent Similarity: | 99.04 | Matching Percent Identity: | 99.04 |
|---|---|---|---|
| Total Percent Similarity: | 80.78 | Total Percent Identity: | 80.78 |
| Gaps: | 1 | | |

Alignment:

```
  8 SYVRAEEGLNFPTYDGKDRVVSLSEKNFKQVLKKYDLLCLYYHEPVSSDK   57
    |   ||||||||||||||||||||||||||||||||||||||||||||||
 15 SSCRAEEGLNFPTYDGKDRVVSLSEKNFKQVLKKYDLLCLYYHEPVSSDK   64

58 VTQKQFQLKEIVLELVAQVLEHKAIGFVMVDAKKEAKLAKKLD.......  100
    |||||||||||||||||||||||||||||||||||||||||||
 65 VTQKQFQLKEIVLELVAQVLEHKAIGFVMVDAKKEAKLAKKLGFDEEGSL  114

100 ..................................................  100
115 YILKGDRTIEFDGEFAADVLVEFLLDLIEDPVEIISSKLEVQAFERIEDY  164

101 ..............YKAFEEAAEHFQPYIKFFATFDKGVAKKLSLKMNEV  136
                  |||||||||||||||||||||||||||||||||||
165 IKLIGFFKSEDSEYYKAFEEAAEHFQPYIKFFATFDKGVAKKLSLKMNEV  214

137 DFYEPFMDEPIAIPNKPYTEEELVEFVKEHQRPTLRRLRPEEMFETWEDD  186
    ||||||||||||||||||||||||||||||||||||||||||||||||||
215 DFYEPFMDEPIAIPNKPYTEEELVEFVKEHQRPTLRRLRPEEMFETWEDD  264

187 LNGIHIVAFAEKSDPDGYEFLEILKQVARDNTDNPDLSILWIDPDDFPLL  236
    ||||||||||||||||||||||||||||||||||||||||||||||||||
265 LNGIHIVAFAEKSDPDGYEFLEILKQVARDNTDNPDLSILWIDPDDFPLL  314
```

-continued

```
237  VAYWEKTFKIDLFRPQIGVVNVTDADSVWMEIPDDDDLPTAEELEDWIED  286
     ||||||||||||||||||||||||||||||||||||||||||||||||||
315  VAYWEKTFKIDLFRPQIGVVNVTDADSVWMEIPDDDDLPTAEELEDWIED  364

287  VLSGKINTEDDDEDDDDDDNSDEEDNDDSDDDDDE                 321
     ||||||||||||||||||||||||||||||||||
365  VLSGKINTEDDDEDDDDDDNSDEEDNDDSDDDDDE                 399
```

Sequence name: /tmp/YOj6jtvAt2/UVZXGVRVOx: CAQ2_HUMAN (SEQ ID NO:349)

Sequence documentation:

Alignment of: N56180_P7 (SEQ ID NO:289) x CAQ2_HUMAN (SEQ ID NO:349).

| Alignment segment 1/1: | | | |
|---|---|---|---|
| Quality: | 1959.00 | Escore: | 0 |
| Matching length: | 197 | Total length: | 197 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
16   VAKKLSLKMNEVDFYEPFMDEPIAIPNKPYTEEELVEFVKEHQRPTLRRL  65
     |||||||||||||||||||||||||||||||||||||||||||||||||
203  VAKKLSLKMNEVDFYEPFMDEPIAIPNKPYTEEELVEFVKEHQRPTLRRL  252

66   RPEEMFETWEDDLNGIHIVAFAEKSDPDGYEFLEILKQVARDNTDNPDLS  115
     |||||||||||||||||||||||||||||||||||||||||||||||||
253  RPEEMFETWEDDLNGIHIVAFAEKSDPDGYEFLEILKQVARDNTDNPDLS  302

116  ILWIDPDDFPLLVAYWEKTFKIDLFRPQIGVVNVTDADSVWMEIPDDDDL  165
     |||||||||||||||||||||||||||||||||||||||||||||||||
303  ILWIDPDDFPLLVAYWEKTFKIDLFRPQIGVVNVTDADSVWMEIPDDDDL  352

166  PTAEELEDWIEDVLSGKINTEDDDEDDDDDDNSDEEDNDDSDDDDDE     212
     ||||||||||||||||||||||||||||||||||||||||||||||
353  PTAEELEDWIEDVLSGKINTEDDDEDDDDDDNSDEEDNDDSDDDDDE     399
```

Sequence name: /tmp/kmYMCJ1GuB/no5BPO2sjR: CAQ2_HUMAN (SEQ ID NO:349)

Sequence documentation:

Alignment of: N56180_P8 (SEQ ID NO:290) x CAQ2_HUMAN (SEQ ID NO:349).

| Alignment segment 1/1: | | | |
|---|---|---|---|
| Quality: | 1187.00 | Escore: | 0 |
| Matching length: | 120 | Total length: | 120 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 14  DGYEFLEILKQVARDNTDNPDLSILWIDPDDFPLLVAYWEKTFKIDLFRP   63
     ||||||||||||||||||||||||||||||||||||||||||||||||||
280  DGYEFLEILKQVARDNTDNPDLSILWIDPDDFPLLVAYWEKTFKIDLFRP  329

64  QIGVVNVTDADSVWMEIPDDDDLPTAEELEDWIEDVLSGKINTEDDDEDD  113
     ||||||||||||||||||||||||||||||||||||||||||||||||||
330  QIGVVNVTDADSVWMEIPDDDDLPTAEELEDWIEDVLSGKINTEDDDEDD  379

114  DDDDNSDEEDNDDSDDDDE                                 133
     |||||||||||||||||||
380  DDDDNSDEEDNDDSDDDDE                                 399
```

Sequence name: /tmp/JIYFiyYEk/C42Jok7Lfq: CAQ2_HUMAN (SEQ ID NO:349)
Sequence documentation:
Alignment of: N56180_P9 (SEQ ID NO:291) x CAQ2_HUMAN (SEQ ID NO:349).

| Alignment segment 1/1: | | | |
|---|---|---|---|
| Quality: | 2388.00 | Escore: | 0 |
| Matching length: | 246 | Total length: | 246 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MKRTHLFIVGIYFLSSCRAEEGLNFPTYDGKDRVVSLSEKNFKQVLKKYD   50
     ||||||||||||||||||||||||||||||||||||||||||||||||||
  1  MKRTHLFIVGIYFLSSCRAEEGLNFPTYDGKDRVVSLSEKNFKQVLKKYD   50

51  LLCLYYHEPVSSDKVTQKQFQLKEIVLELVAQVLEHKAIGFVMVDAKKEA  100
     ||||||||||||||||||||||||||||||||||||||||||||||||||
 51  LLCLYYHEPVSSDKVTQKQFQLKEIVLELVAQVLEHKAIGFVMVDAKKEA  100

101  KLAKKLGFDEEGSLYILKGDRTIEFDGEFAADVLVEFLLDLIEDPVEIIS  150
     ||||||||||||||||||||||||||||||||||||||||||||||||||
101  KLAKKLGFDEEGSLYILKGDRTIEFDGEFAADVLVEFLLDLIEDPVEIIS  150

151  SKLEVQAFERIEDYIKLIGFFKSEDSEYYKAFEEAAEHFQPYIKFFATFD  200
     ||||||||||||||||||||||||||||||||||||||||||||||||||
151  SKLEVQAFERIEDYIKLIGFFKSEDSEYYKAFEEAAEHFQPYIKFFATFD  200

201  KGVAKKLSLKMNEVDFYEPFMDEPIAIPNKPYTEEELVEFVKEHQR      246
     ||||||||||||||||||||||||||||||||||||||||||||||
201  KGVAKKLSLKMNEVDFYEPFMDEPIAIPNKPYTEEELVEFVKEHQR      246
```

Expression of Calsequestrin, Cardiac Muscle Isoform Transcripts which are Detectable by Amplicon as Depicted in Sequence Name N56180 Specifically in Heart Tissue Expression of Calsequestrin, cardiac muscle isoform transcripts detectable by or according to seg6 (SEQ ID NO:335), N56180 amplicon(s) and N56180 seg6F (SEQ ID NO:279) and N56180 seg6R (SEQ ID NO:280) primers was measured by real time PCR. In parallel the expression of four housekeeping genes—RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)), Ubiquitin (GenBank Accession No. BC000449 (SEQ ID NO:445); amplicon—Ubiquitin-amplicon (SEQ ID NO:448)) and SDHA (GenBank Accession No. NM_004168 (SEQ ID NO:449); amplicon—SDHA-amplicon (SEQ ID NO:452)) was measured similarly. For each RT sample, the expression of the above amplicons was normalized to the geometric mean of the quantities of the housekeeping genes. The normalized quantity of each RT sample was then divided by the median of the quantities of the heart samples (Sample Nos. 44, 45, 46, Table 1, above, "Tissue samples in testing panel"), to obtain a value of fold up-regulation for each sample relative to median of the heart.

Figure 9:
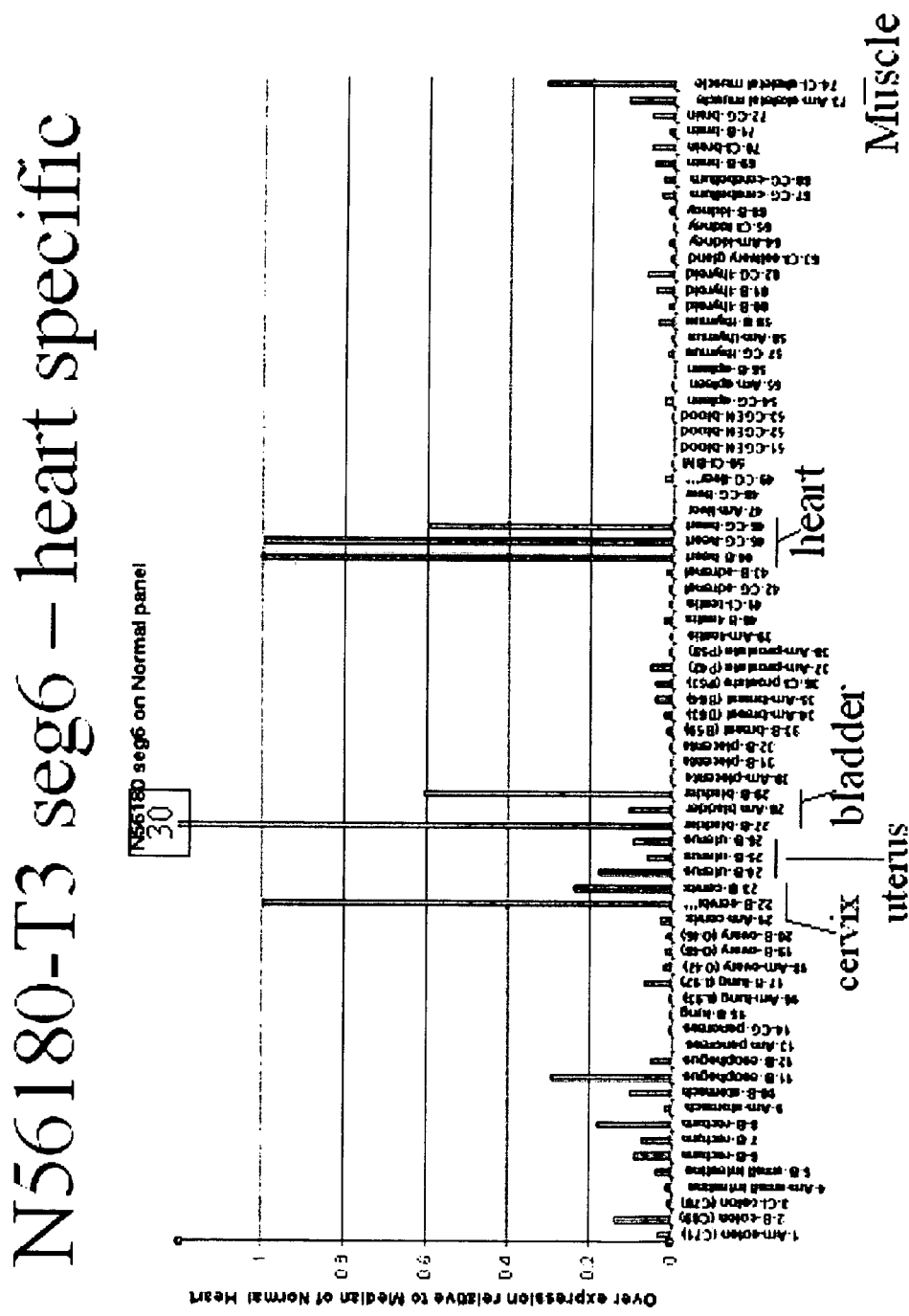
FIG. 9 is a histogram showing specific expression of the above-indicated Calsequestrin, cardiac muscle isoform transcripts in sequence N56180, heart tissue samples (SEQ ID NO:335).

FIG. 9 is a histogram showing specific expression of the above-indicated Calsequestrin, cardiac muscle isoform transcripts in heart tissue samples as opposed to other tissues. As is evident from FIG. 9, the expression of Calsequestrin, cardiac muscle isoform transcripts detectable by the above amplicon(s) in heart tissue samples was significantly higher than in most other samples (non-heart tissue sample Nos. 1-21, 23-26, 28, 30-43 47-74 Table 1 above, "Tissue samples in testing panel").

Primer pairs are also optionally and preferably encompassed within the present invention; for example, for the above experiment, the following primer pair was used as a non-limiting illustrative example only of a suitable primer pair: N56180 seg6F (SEQ ID NO:279) forward primer; and N56180 seg6R (SEQ ID NO:280) reverse primer.

The present invention also preferably encompasses any amplicon obtained through the use of any suitable primer pair; for example, for the above experiment, the following amplicon was obtained as a non-limiting illustrative example only of a suitable amplicon: N56180 seg6.

N56180 seg6F (SEQ ID NO:279):
ATATCCCAGTGGTGGTTGCATT

N56180 seg6R (SEQ ID NO:280):
CCCTCCCCAGCGTTTCC

N56180 seg6 (SEQ ID NO:335):
ATATCCCAGTGGTGGTTGCATTTCCAAACCCCAAGAGAGGAAGGCAAAAT
GAAGTTGCTGGAGTTGAGTGAATCTGCAGATGGAGCTGCGTGGAAACGCT
GGGGAGGG Expression of Calsequestrin, cardiac muscle isoform transcripts detectable by or according to seg22 node(s), N56180 amplicon(s) and N56180 seg22F (SEQ ID NO:336) and N56180 seg22R (SEQ ID NO:337) primers was measured by real time PCR. In parallel the expression of four housekeeping genes—RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)), Ubiquitin (GenBank Accession No. BC000449 (SEQ ID NO:445); amplicon—Ubiquitin-amplicon (SEQ ID NO:448)) and SDHA (GenBank Accession No. NM_004168 (SEQ ID NO:449); amplicon—SDHA-amplicon (SEQ ID NO:452)), was measured similarly. For each RT sample, the expression of the above amplicons was normalized to the geometric mean of the quantities of the housekeeping genes. The normalized quantity of each RT sample was then divided by the median of the quantities of the heart samples (Sample Nos. 44, 45, 46, Table 1, above, "Tissue samples in testing panel"), to obtain a value of fold up-regulation for each sample relative to median of the heart.

Figure 10:
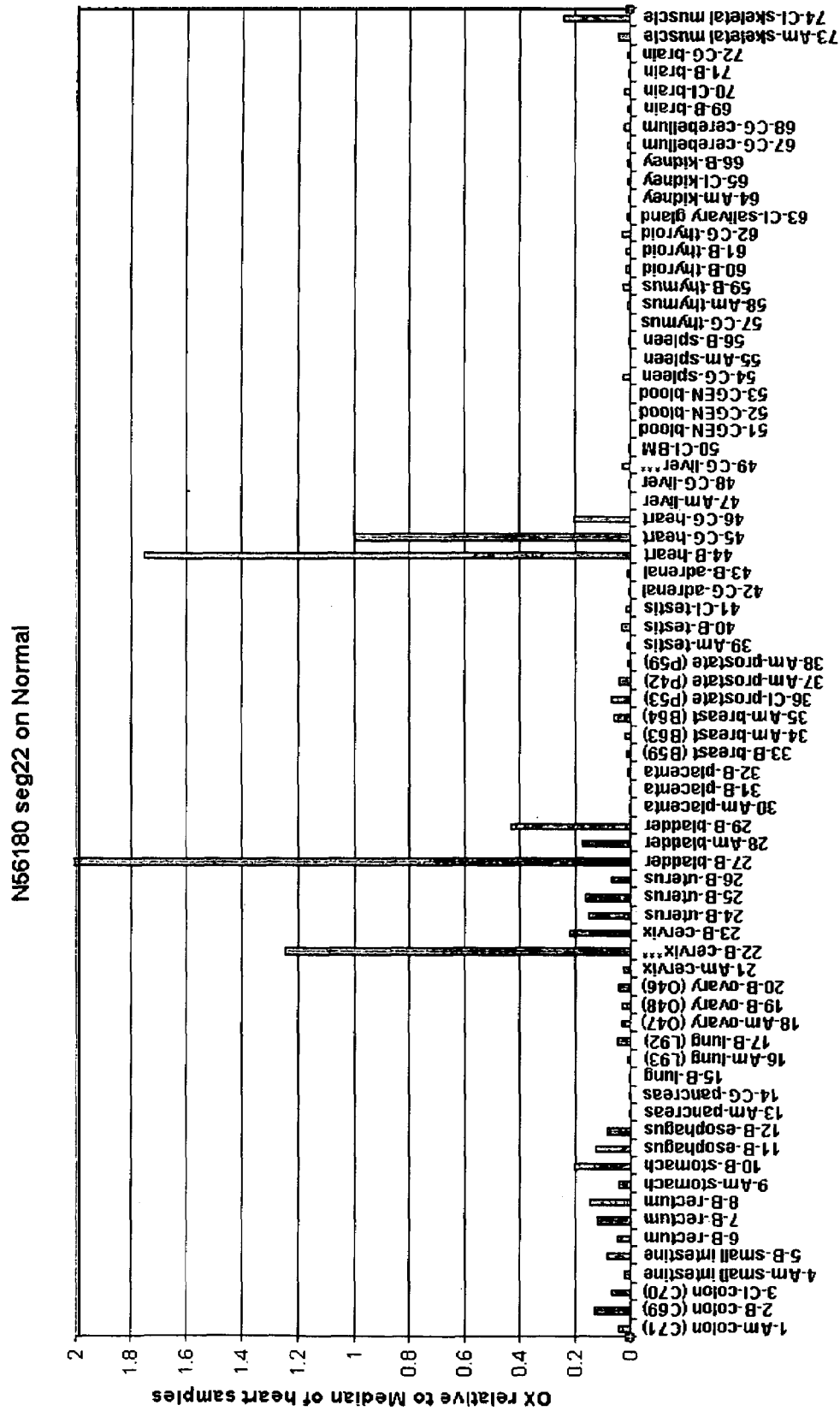
FIG. 10 is a histogram showing specific expression of the above-indicated Calsequestrin, cardiac muscle isoform transcripts in heart tissue samples as opposed to other tissues (SEQ ID NO:361).

FIG. 10 is a histogram showing specific expression of the above-indicated Calsequestrin, cardiac muscle isoform transcripts in heart tissue samples as opposed to other tissues. As is evident from FIG. 10, the expression of Calsequestrin, cardiac muscle isoform transcripts detectable by the above amplicon(s) in heart tissue samples was significantly higher than in most of the other samples (non-heart tissue sample Nos. 1-21, 23-26, 28-43, 47-74 Table 1, "Tissue samples in testing panel").

Primer pairs are also optionally and preferably encompassed within the present invention; for example, for the above experiment, the following primer pair was used as a non-limiting illustrative example only of a suitable primer pair: N56180 seg22F (SEQ ID NO:336) forward primer; and N56180 seg22R (SEQ ID NO:337) reverse primer.

The present invention also preferably encompasses any amplicon obtained through the use of any suitable primer pair; for example, for the above experiment, the following amplicon was obtained as a non-limiting illustrative example only of a suitable amplicon: N56180 seg22.

N56180 seg22F (SEQ ID NO:336):
TTGATACCACTTAGTGTAGCTCCAGC

N56180 seg22R (SEQ ID NO:337):
TCAAGTAGTTGCTACAGACGCCA

N56180 seg22 (SEQ ID NO:361):
TTGATACCACTTAGTGTAGCTCCAGCATGGATCAGCAAACTTTTTCTGT
AAAGAACAAAATGGTAAATATTTCAGGTTCTGTGGGCCAGATGGCGTCT
GTAGCAACTACTTGA Description for Cluster T10377

Cluster T10377 features 6 transcript(s) and 18 segment(s) of interest, the names for which are given in Tables 1 and 2, respectively, the sequences themselves are given at the end of the application. The selected protein variants are given in table 3.

TABLE 1

Transcripts of interest

| Transcript Name | Seq ID No. |
|---|---|
| T10377_T0 | 12 |
| T10377_T1 | 13 |
| T10377_T2 | 14 |
| T10377_T5 | 15 |
| T10377_T6 | 16 |
| T10377_T7 | 17 |

TABLE 2

Segments of interest

| Segment Name | Seq ID No. |
|---|---|
| T10377_node_0 | 95 |
| T10377_node_17 | 96 |
| T10377_node_19 | 97 |
| T10377_node_21 | 98 |
| T10377_node_27 | 99 |
| T10377_node_33 | 100 |
| T10377_node_12 | 101 |
| T10377_node_14 | 102 |
| T10377_node_16 | 103 |
| T10377_node_2 | 104 |
| T10377_node_23 | 105 |
| T10377_node_25 | 106 |
| T10377_node_29 | 107 |
| T10377_node_3 | 108 |
| T10377_node_31 | 109 |
| T10377_node_5 | 110 |
| T10377_node_8 | 111 |
| T10377_node_9 | 112 |

TABLE 3

Proteins of interest

| Protein Name | Seq ID No. |
|---|---|
| T10377_P2 | 292 |
| T10377_P5 | 293 |
| T10377_P6 | 294 |
| T10377_P7 | 295 |
| T10377_P8 | 296 |

The heart-selective diagnostic marker prediction engine provided the following results with regard to cluster T10377. Predictions were made for selective expression of transcripts of this cluster in heart tissue, according to the previously described methods. The numbers on the y-axis of FIG. 11 refer to weighted expression of ESTs in each category, as "parts per million" (ratio of the expression of ESTs for a particular cluster to the expression of all ESTs in that category, according to parts per million).

Figure 11:
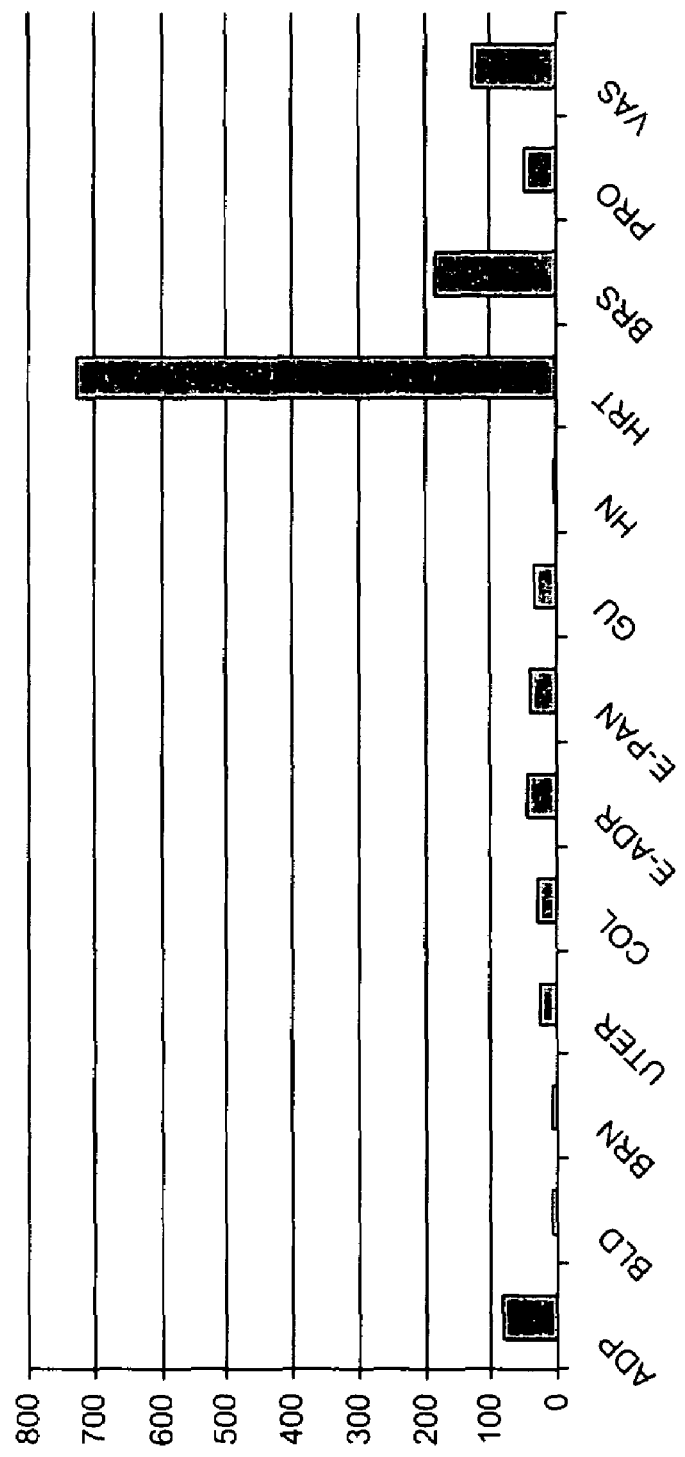
FIG. 11 is a histogram showing expression of concerning the number of heart tissue-specific clones in libraries/sequences.

Overall, the following results were obtained as shown with regard to the histogram in FIG. 11, concerning the number of heart-specific clones in libraries/sequences.

This cluster was found to be selectively expressed in heart for the following reasons: in a comparison of the ratio of expression of the cluster in heart specific ESTs to the overall expression of the cluster in non-heart ESTs, which was found to be 10.9. The expression level of this gene in muscle was negligible; and fisher exact test P-values were computed both for library and weighted clone counts to check that the counts are statistically significant, and were found to be 8.60 E-15.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the expression level of this gene in muscle was negligible, which clearly supports specific expression in heart tissue.

As noted above, cluster T10377 features 6 transcript(s), which were listed in Table 1 above. A description of each variant protein according to the present invention is now provided.

Variant protein T10377_P2 (SEQ ID NO:292) according to the present invention has an amino acid sequence as given at the end of the application; it is encoded by transcript(s) T10377_T1 (SEQ ID NO:13) and T10377_T2 (SEQ ID NO:14). One or more alignments to one or more previously published protein sequences are given at the end of the application. A brief description of the relationship of the variant protein according to the present invention to each such aligned protein is as follows:

Comparison report between T10377_P2 (SEQ ID NO:292) and Q96NF5 (SEQ ID NO:362):

1. An isolated chimeric polypeptide encoding for T10377_P2 (SEQ ID NO:292), comprising a first amino acid sequence being at least 70%, optionally at least 80%, preferably at least 85%, more preferably at least 90% and most preferably at least 95% homologous to a polypeptide having the sequence MEISLVKCSE (SEQ ID NO:406) corresponding to amino acids 1-10 of T10377_P2 (SEQ ID NO:292), second amino acid sequence being at least 90% homologous to ANVCRLRLTVPPESPVPEQCEKKI-ERKEQLLDLSNGEPTRKLPQGVVYGVVR RSDQNQQKEMVVYGWSTSQLKEEMNY-IKDVRATLEKVRKRMYGDYDEMR QKIRQLTQELSVSHAQQEYLENHIQTQS-SALDRFNAMNSALASDSIGLQKTL VDVTLEN-SNIKDQIRNLQQTYEASMDKLREKQRQL-EVAQVENQLLKMKVES SQEANAEVMREMTKKLYSQYEEKLQE-EQRKHSAEKEALLEETNSFLK corresponding to amino acids 26-276 of Q96NF5 (SEQ ID NO:362), which also corresponds to amino acids 11-261 of T10377_P2 (SEQ ID NO:292), followed by A, and a third amino acid sequence being at least 90% homologous to IEEANKKM-QAAEISLEEKDQRIGELDRLIERMEKER-HQLQLQLLEHETEMSG ELTDSDKERYQQLEEASASLRERIRHLD-DMVHCQQKKVKQMVEEIESLKKK LQQKQL-LILQLLEKISFLEGENNELQS-RLDYLTETQAKTEVETREIGVGCDLL PSQTGRTREIVMPSRNYTPYTRVLELTMKKTLT corresponding to amino acids 278-466 of Q96NF5 (SEQ ID NO:362), which also corresponds to amino acids 263-451 of T10377_P2 (SEQ ID NO:292), wherein said first, second, A, and third amino acid sequences are contiguous and in a sequential order.

2. An isolated polypeptide encoding for a head of T10377_P2 (SEQ ID NO:292), comprising a polypeptide being at least 70%, optionally at least about 80%, preferably at least about 85%, more preferably at least about 90% and most preferably at least about 95% homologous to the sequence MEISLVKCSE (SEQ ID NO:406) of T10377_P2 (SEQ ID NO:292).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein T10377_P2 (SEQ ID NO:292) also has the following non-silent SNPs (Single Nucleotide Polymorphisms) as listed in Table 5, (given according to their position(s) on the amino acid sequence, with the alternative amino acid(s) listed; the last column indicates whether the SNP is known or not; the presence of known SNPs in variant protein T10377_P2 (SEQ ID NO:292) sequence provides support for the deduced sequence of this variant protein according to the present invention).

TABLE 5

Amino acid mutations

| SNP position(s) on amino acid sequence | Alternative amino acid(s) | Previously known SNP? |
| --- | --- | --- |
| 262 | A -> V | No |
| 30 | C -> S | No |
| 323 | R -> G | No |
| 36 | R -> K | No |
| 439 | T -> | No |

Variant protein T10377_P2 (SEQ ID NO:292) is encoded by the following transcript(s): T10377_T1 (SEQ ID NO:13) and T10377_T2 (SEQ ID NO:14), for which the sequence(s) is/are given at the end of the application.

The coding portion of transcript T10377_T1 (SEQ ID NO:13) is shown in bold; this coding portion starts at position 166 and ends at position 1518. The transcript also has the following SNPs as listed in Table 6 (given according to their position on the nucleotide sequence, with the alternative nucleic acid listed; the last column indicates whether the SNP is known or not; the presence of known SNPs in variant protein T10377_P2 (SEQ ID NO:292) sequence provides support for the deduced sequence of this variant protein according to the present invention).

TABLE 6

Nucleic acid SNPs

| SNP position on nucleotide sequence | Alternative nucleic acid | Previously known SNP? |
| --- | --- | --- |
| 152 | A -> T | Yes |
| 253 | T -> A | No |
| 272 | G -> A | No |
| 624 | A -> G | Yes |
| 786 | G -> A | No |

TABLE 6-continued

| Nucleic acid SNPs | | |
|---|---|---|
| SNP position on nucleotide sequence | Alternative nucleic acid | Previously known SNP? |
| 950 | C -> T | No |
| 1077 | A -> G | No |
| 1132 | A -> G | No |
| 1482 | A -> | No |

The coding portion of transcript T10377_T2 (SEQ ID NO:14) is shown in bold; this coding portion starts at position 270 and ends at position 1622. The transcript also has the following SNPs as listed in Table 7 (given according to their position on the nucleotide sequence, with the alternative nucleic acid listed; the last column indicates whether the SNP is known or not; the presence of known SNPs in variant protein T10377_P2 (SEQ ID NO:292) sequence provides support for the deduced sequence of this variant protein according to the present invention).

TABLE 7

| Nucleic acid SNPs | | |
|---|---|---|
| SNP position on nucleotide sequence | Alternative nucleic acid | Previously known SNP? |
| 13 | G -> T | Yes |
| 26 | G -> A | Yes |
| 890 | G -> A | No |
| 1054 | C -> T | No |
| 1181 | A -> G | No |
| 1236 | A -> G | No |
| 1586 | A -> | No |
| 88 | C -> T | Yes |
| 115 | G -> A | Yes |
| 126 | A -> G | Yes |
| 212 | A -> G | No |
| 256 | A -> T | Yes |
| 357 | T -> A | No |
| 376 | G -> A | No |
| 728 | A -> G | Yes |

Variant protein T10377_P5 (SEQ ID NO:293) according to the present invention has an amino acid sequence as given at the end of the application; it is encoded by transcript(s) T10377_T5 (SEQ ID NO:15).

One or more alignments to one or more previously published protein sequences are given at the end of the application. A brief description of the relationship of the variant protein according to the present invention to each such aligned protein is as follows:

Comparison report between T10377_P5 (SEQ ID NO:293) and Q96NF5 (SEQ ID NO:362):

1. An isolated chimeric polypeptide encoding for T10377_P5 (SEQ ID NO:293), comprising a first amino acid sequence being at least 90% homologous to MLRSTSTVTLLSGGAARTPGAPSRRAN-VCRLRLTVPPESPVPEQCEKKIERKE QLLDL-SNGEPTRKLPQGVVYGVVRRSDQN-QQKEMVVYGWSTSQLKEEMN YIKDVRATLEKVRKRMYGDYDEM-RQKIRQLTQELSVSHAQQEYLENHIQTQ SSAL-DRFNAMNSALASDSIGLQKTLVDVTLEN-SNIKDQIRNLQQTYEASMDK LREKQRQLEVAQVENQLLKMKVESSQEA-NAEVMREMTKKLYSQYEEKLQE EQRKH-SAEKEALLEETNSFLK corresponding to amino acids 1-276 of Q96NF5 (SEQ ID NO:362), which also corresponds to amino acids 1-276 of T10377_P5 (SEQ ID NO:293), followed by A, a second amino acid sequence being at least 90% homologous to IEE-ANKKMQAAEISLEEKDQRIGELDRLIER-MEKERHQLQLQLLEHETEMSG ELTDSDK-ERYQQLEEASASLRERIRHLDDMVHCQQKKVK QMVE corresponding to amino acids 278-372 of Q96NF5 (SEQ ID NO:362), which also corresponds to amino acids 278-372 of T10377_P5 (SEQ ID NO:293), and a third amino acid sequence being at least 90% homologous to ENNELQSRLDYLTETQAKTEVE-TREIGVGCDLLPSQTGRTREIVMPSRNYTPY TRVLELTMKKTLT corresponding to amino acids 401-466 of Q96NF5 (SEQ ID NO:362), which also corresponds to amino acids 373-438 of T10377_P5 (SEQ ID NO:293), wherein said first, A, second, and third amino acid sequences are contiguous and in a sequential order.

2. An isolated chimeric polypeptide encoding for an edge portion of T10377_P5 (SEQ ID NO:293), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EE, having a structure as follows: a sequence starting from any of amino acid numbers 372−x to 372; and ending at any of amino acid numbers 373+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide, NN:NO) predicts that this protein has a signal peptide.

Variant protein T10377_P5 (SEQ ID NO:293) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein T10377_P5 (SEQ ID NO:293) sequence provides support for the deduced sequence of this variant protein according to the present invention).

TABLE 8

| Amino acid mutations | | |
|---|---|---|
| SNP position(s) on amino acid sequence | Alternative amino acid(s) | Previously known SNP? |
| 25 | R -> G | No |
| 277 | A -> V | No |
| 338 | R -> G | No |
| 426 | T -> | No |
| 45 | C -> S | No |
| 51 | R -> K | No |

Variant protein T10377_P5 (SEQ ID NO:293) is encoded by the following transcript(s): T10377_T5 (SEQ ID NO:15), for which the sequence(s) is/are given at the end of the application. The coding portion of transcript T10377_T5

(SEQ ID NO:15) is shown in bold; this coding portion starts at position 140 and ends at position 1453. The transcript also has the following SNPs as listed in Table 9 (given according to their position on the nucleotide sequence, with the alternative nucleic acid listed; the last column indicates whether the SNP is known or not; the presence of known SNPs in variant protein T10377_P5 (SEQ ID NO:293) sequence provides support for the deduced sequence of this variant protein according to the present invention).

TABLE 9

Nucleic acid SNPs

| SNP position o nucleotide sequence | Alternative nucleic acid | Previously known SNP? |
|---|---|---|
| 13 | G -> T | Yes |
| 26 | G -> A | Yes |
| 969 | C -> T | No |
| 1096 | A -> G | No |
| 1151 | A -> G | No |
| 1417 | A -> | No |
| 88 | C -> T | Yes |
| 115 | G -> A | Yes |
| 126 | A -> G | Yes |
| 212 | A -> G | No |
| 272 | T -> A | No |
| 291 | G -> A | No |
| 643 | A -> G | Yes |
| 805 | G -> A | No |

Variant protein T10377_P6 (SEQ ID NO:294) according to the present invention has an amino acid sequence as given at the end of the application; it is encoded by transcript(s) T10377_T6 (SEQ ID NO:16).

One or more alignments to one or more previously published protein sequences are given at the end of the application. A brief description of the relationship of the variant protein according to the present invention to each such aligned protein is as follows:

Comparison report between T10377_P6 (SEQ ID NO:294) and Q96NF5 (SEQ ID NO:362):

1. An isolated chimeric polypeptide encoding for T10377_P6 (SEQ ID NO:294), comprising a first amino acid sequence being at least 90% homologous to MLRSTSTVTLLSGGAARTPGAPSRRAN-VCRLRLTVPPESPVPEQCEKKIERKE QLLDL-SNGEPTRKLPQGVVYGVVRRSDQN-QQKEMVVYGWSTSQLKEEMN YIKDVRATLEKVRKRMYGDYDEM-RQKIRQLTQELSVSHAQQEYLENHIQTQ SSAL-DRFNAMNSALASDSIGLQKTLVDVTLEN-SNIKDQIRNLQQTYEASMDK LREKQRQLEVAQVENQLLKMKVESSQEA-NAEVMREMTKKLYSQYEEKLQE EQRKH-SAEKEALLEETNSFLK corresponding to amino acids 1-276 of Q96NF5 (SEQ ID NO:362), which also corresponds to amino acids 1-276 of T10377_P6 (SEQ ID NO:294), followed by A, a second amino acid sequence being at least 90% homologous to IEE-ANKKMQAAEISLEEKDQRIGELDRLIER-MEKERHQLQLQLLEHETEMSG ELTDSDK-ERYQQLEEASASLRERIRHLDDMVHCQQKKVK QMVEEIESLKKK LQQKQLLILQLLEKISFLEGE corresponding to amino acids 278-401 of Q96NF5 (SEQ ID NO:362), which also corresponds to amino acids 278-401 of T10377_P6 (SEQ ID NO:294), and a third amino acid sequence being at least 70%, optionally at least 80%, preferably at least 85%, more preferably at least 90% and most preferably at least 95% homologous to a polypeptide having the sequence PNRQDS (SEQ ID NO:407) corresponding to amino acids 402-407 of T10377_P6 (SEQ ID NO:294), wherein said first, A, second and third amino acid sequences are contiguous and in a sequential order.

2. An isolated polypeptide encoding for a tail of T10377_P6 (SEQ ID NO:294), comprising a polypeptide being at least 70%, optionally at least about 80%, preferably at least about 85%, more preferably at least about 90% and most preferably at least about 95% homologous to the sequence PNRQDS (SEQ ID NO:407) in T10377_P6 (SEQ ID NO:294).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide, NN:NO) predicts that this protein has a signal peptide.

Variant protein T10377_P6 (SEQ ID NO:294) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein T10377_P6 (SEQ ID NO:294) sequence provides support for the deduced sequence of this variant protein according to the present invention).

TABLE 10

Amino acid mutations

| SNP position(s) on amino acid sequence | Alternative amino acid(s) | Previously known SNP? |
|---|---|---|
| 25 | R -> G | No |
| 277 | A -> V | No |
| 338 | R -> G | No |
| 45 | C -> S | No |
| 51 | R -> K | No |

Variant protein T10377_P6 (SEQ ID NO:294) is encoded by the following transcript(s): T10377_T6 (SEQ ID NO:16), for which the sequence(s) is/are given at the end of the application. The coding portion of transcript T10377_T6 (SEQ ID NO:16) is shown in bold; this coding portion starts at position 140 and ends at position 1360. The transcript also has the following SNPs as listed in Table 11 (given according to their position on the nucleotide sequence, with the alternative nucleic acid listed; the last column indicates whether the SNP is known or not; the presence of known SNPs in variant protein T10377_P6 (SEQ ID NO:294) sequence provides support for the deduced sequence of this variant protein according to the present invention).

TABLE 11

Nucleic acid SNPs

| SNP position on nucleotide sequence | Alternative nucleic acid | Previously known SNP? |
|---|---|---|
| 13 | G -> T | Yes |
| 26 | G -> A | Yes |
| 969 | C -> T | No |

TABLE 11-continued

| Nucleic acid SNPs | | |
|---|---|---|
| SNP position on nucleotide sequence | Alternative nucleic acid | Previously known SNP? |
| 1096 | A -> G | No |
| 1151 | A -> G | No |
| 1400 | A -> | No |
| 88 | C -> T | Yes |
| 115 | G -> A | Yes |
| 126 | A -> G | Yes |
| 212 | A -> G | No |
| 272 | T -> A | No |
| 291 | G -> A | No |
| 643 | A -> G | Yes |
| 805 | G -> A | No |

Variant protein T10377_P7 (SEQ ID NO:295) according to the present invention has an amino acid sequence as given at the end of the application; it is encoded by transcript(s) T10377_T7 (SEQ ID NO:17).

One or more alignments to one or more previously published protein sequences are given at the end of the application. A brief description of the relationship of the variant protein according to the present invention to each such aligned protein is as follows:

Comparison report between T10377_P7 (SEQ ID NO:295) and Q96NF5 (SEQ ID NO:362):

1. An isolated chimeric polypeptide encoding for T10377_P7 (SEQ ID NO:295), comprising a first amino acid sequence being at least 90% homologous to MLRSTSTVTLLSGGAARTPGAPSRRAN-VCRLRLTVPPESPVPEQCEKKIERKE QLLDL-SNGEPTRKLPQGVVYGVVRRSDQN-QQKEMVVYGWSTSQLKEEMN YIKDVRATLEKVRKRMYGDYDEM-RQKIRQLTQELSVSHAQQEYLENHIQTQ SSAL-DRFNAMNSALASDSIGLQKTLVDVTLEN-SNIKDQIRNLQQTYEASMDK LREKQRQLEVAQVENQLLKMKVESSQEA-NAEVMREMTKKLYSQYEEKLQE EQRKH-SAEKEALLEETNSFLK corresponding to amino acids 1-276 of Q96NF5 (SEQ ID NO:362), which also corresponds to amino acids 1-276 of T10377_P7 (SEQ ID NO:295), followed by A, a second amino acid sequence being at least 90% homologous to IEE-ANKKMQAAEISLEEKDQRIGELDRLIER-MEKERHQLQLQLLEHETEMSG ELTDSDK-ERYQQLEEASASLRERIRHLDDMVHCQQKKVK QMVEEI corresponding to amino acids 278-374 of Q96NF5 (SEQ ID NO:362), which also corresponds to amino acids 278-374 of T10377_P7 (SEQ ID NO:295), and a third amino acid sequence being at least 70%, optionally at least 80%, preferably at least 85%, more preferably at least 90% and most preferably at least 95% homologous to a polypeptide having the sequence MSHELFSRFSLRLFGR (SEQ ID NO:408) corresponding to amino acids 375-390 of T10377_P7 (SEQ ID NO:295), wherein said first, A, second and third amino acid sequences are contiguous and in a sequential order.
2. An isolated polypeptide encoding for a tail of T10377_P7 (SEQ ID NO:295), comprising a polypeptide being at least 70%, optionally at least about 80%, preferably at least about 85%, more preferably at least about 90% and most preferably at least about 95% homologous to the sequence MSHELFSRFSLRLFGR (SEQ ID NO:408) in T10377_P7 (SEQ ID NO:295).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide, NN:NO) predicts that this protein has a signal peptide.

Variant protein T10377_P7 (SEQ ID NO:295) also has the following non-silent SNPs (Single Nucleotide Polymorphisms) as listed in Table 12, (given according to their position(s) on the amino acid sequence, with the alternative amino acid(s) listed; the last column indicates whether the SNP is known or not; the presence of known SNPs in variant protein T10377_P7 (SEQ ID NO:295) sequence provides support for the deduced sequence of this variant protein according to the present invention).

TABLE 12

| Amino acid mutations | | |
|---|---|---|
| SNP position(s) on amino acid sequence | Alternative amino acid(s) | Previously known SNP? |
| 25 | R -> G | No |
| 277 | A -> V | No |
| 338 | R -> G | No |
| 45 | C -> S | No |
| 51 | R -> K | No |

Variant protein T10377_P7 (SEQ ID NO:295) is encoded by the following transcript(s): T10377_T7 (SEQ ID NO:17), for which the sequence(s) is/are given at the end of the application. The coding portion of transcript T10377_T7 (SEQ ID NO:17) is shown in bold; this coding portion starts at position 140 and ends at position 1309. The transcript also has the following SNPs as listed in Table 13 (given according to their position on the nucleotide sequence, with the alternative nucleic acid listed; the last column indicates whether the SNP is known or not; the presence of known SNPs in variant protein T10377_P7 (SEQ ID NO:295) sequence provides support for the deduced sequence of this variant protein according to the present invention).

TABLE 13

| Nucleic acid SNPs | | |
|---|---|---|
| SNP position on nucleotide sequence | Alternative nucleic acid | Previously known SNP? |
| 13 | G -> T | Yes |
| 26 | G -> A | Yes |
| 969 | C -> T | No |
| 1096 | A -> G | No |
| 1151 | A -> G | No |
| 88 | C -> T | Yes |
| 115 | G -> A | Yes |
| 126 | A -> G | Yes |
| 212 | A -> G | No |
| 272 | T -> A | No |
| 291 | G -> A | No |
| 643 | A -> G | Yes |
| 805 | G -> A | No |

Protein T10377_P8 (SEQ ID NO:296) has an amino acid sequence as given at the end of the application; it is encoded by transcript(s) T10377_T0 (SEQ ID NO:12). One or more alignments to one or more previously published protein sequences are given at the end of the application. A brief description of the relationship of the variant protein according to the present invention to each such aligned protein is as follows:

Comparison report between T10377_P8 (SEQ ID NO:296) and Q96NF5 (SEQ ID NO:362):

An isolated chimeric polypeptide encoding for T10377_P8 (SEQ ID NO:296), comprising a first amino acid sequence being at least 90% homologous to MEIS-LVKCSEANVCRLRLTVPPESPVPEQCEK-KIERKEQLLDLSNGEPTRKLPQGVVYG VVRRSDQN-QQKEMVVYGWSTSQLKEEMNYIKDVRATLEKVRK RMYGDYDEMRQKIR QLTQELSVSHAQQEYLEN-HIQTQSSALDRFNAMNSALASDSIGLQK-TLVDVTLENSNIK DQIRNLQQTYEASMDKL-REKQRQLEVAQVENQLLKMKVESSQEANAEVMRE MTKKL YSQYEEKLQEEQRKHSAEKEALLEETNSFLK corresponding to amino acids 1-261 of Q96NF5 (SEQ ID NO:362), which also corresponds to amino acids 1-261 of T10377_P8 (SEQ ID NO:296), a second amino acid sequence comprising A, and a third amino acid sequence being at least 90% homologous to IEEANKKM-QAAEISLEEKDQRIGELDRLIERMEKER-HQLQLQLLEHETEMSGELTDSDK ERYQQLEE-ASASLRERIRHLDDMVHCQQKKVKQMVEEIESLKK KLQQKQLLILQLLEKI SFLEGENNELQS-RLDYLTETQAKTEVE-TREIGVGCDLLPSQTGRTREIVMPSRNYTPYTR VLELTMKKTLT corresponding to amino acids 263-451 of Q96NF5 (SEQ ID NO:362), which also corresponds to amino acids 263-451 of T10377_P8 (SEQ ID NO:296), wherein said first, second and third amino acid sequences are contiguous and in a sequential order.

The location of the protein was determined according to results from a number of different software programs and analyses, including analyses from SignalP and other specialized programs. The protein is believed to be located as follows with regard to the cell: secreted. The protein localization is believed to be secreted because one of the two signal-peptide prediction programs (HMM:Signal peptide, NN:NO) predicts that this protein has a signal peptide.

Protein T10377_P8 (SEQ ID NO:296) also has the following non-silent SNPs (Single Nucleotide Polymorphisms) as listed in Table 14, (given according to their position(s) on the amino acid sequence, with the alternative amino acid(s) listed; the last column indicates whether the SNP is known or not; the presence of known SNPs in protein T10377_P8 (SEQ ID NO:296) sequence provides support for the deduced sequence of this protein according to the present invention).

TABLE 14

Amino acid mutations

| SNP position(s) on amino acid sequence | Alternative amino acid(s) | Previously known SNP? |
|---|---|---|
| 25 | R -> G | No |
| 277 | V -> A | No |
| 338 | R -> G | No |
| 45 | C -> S | No |
| 454 | T -> | No |
| 51 | R -> K | No |

Protein T10377_P8 (SEQ ID NO:296) is encoded by the following transcript(s): T10377_T0 (SEQ ID NO:12), for which the sequence(s) is/are given at the end of the application. The coding portion of transcript T10377$_{13}$ T0 (SEQ ID NO:12) is shown in bold; this coding portion starts at position 140 and ends at position 1537. The transcript also has the following SNPs as listed in Table 15 (given according to their position on the nucleotide sequence, with the alternative nucleic acid listed; the last column indicates whether the SNP is known or not; the presence of known SNPs in protein T10377_P8 (SEQ ID NO:296) sequence provides support for the deduced sequence of this protein according to the present invention).

TABLE 15

Nucleic acid SNPs

| SNP position on nucleotide sequence | Alternative nucleic acid | Previously known SNP? |
|---|---|---|
| 13 | G -> T | Yes |
| 26 | G -> A | Yes |
| 969 | C -> T | No |
| 1096 | A -> G | No |
| 1151 | A -> G | No |
| 1501 | A -> | No |
| 88 | C -> T | Yes |
| 115 | G -> A | Yes |
| 126 | A -> G | Yes |
| 212 | A -> G | No |
| 272 | T -> A | No |
| 291 | G -> A | No |
| 643 | A -> G | Yes |
| 805 | G -> A | No |

As noted above, cluster T10377 features 18 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T10377_node_0 (SEQ ID NO:95) according to the present invention is supported by 25 libraries. The number of libraries was determined as previously described. This segment can be found in the following transcript(s): T10377_T0 (SEQ ID NO:12), T10377_T2 (SEQ ID NO:14), T10377_T5 (SEQ ID NO:15), T10377_T6 (SEQ ID NO:16) and T10377_T7 (SEQ ID NO:17). Table 16 below describes the starting and ending position of this segment on each transcript.

TABLE 16

Segment location on transcripts

| Transcript name | Segment starting position | Segment ending position |
|---|---|---|
| T10377_T0 (SEQ ID NO: 12) | 1 | 214 |
| T10377_T2 (SEQ ID NO: 14) | 1 | 214 |
| T10377_T5 (SEQ ID NO: 15) | 1 | 214 |
| T10377_T6 (SEQ ID NO: 16) | 1 | 214 |
| T10377_T7 (SEQ ID NO: 17) | 1 | 214 |

Segment cluster T10377_node_17 (SEQ ID NO:96) according to the present invention is supported by 36 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14), T10377_T5 (SEQ ID NO:15), T10377_T6 (SEQ ID NO:16) and T10377_T7 (SEQ ID NO:17). Table 17 below describes the starting and ending position of this segment on each transcript.

TABLE 17

Segment location on transcripts

| Transcript name | Segment starting position | Segment ending position |
| --- | --- | --- |
| T10377_T0 (SEQ ID NO: 12) | 685 | 817 |
| T10377_T1 (SEQ ID NO: 13) | 666 | 798 |
| T10377_T2 (SEQ ID NO: 14) | 770 | 902 |
| T10377_T5 (SEQ ID NO: 15) | 685 | 817 |
| T10377_T6 (SEQ ID NO: 16) | 685 | 817 |
| T10377_T7 (SEQ ID NO: 17) | 685 | 817 |

Segment cluster T10377_node_19 (SEQ ID NO:97) according to the present invention is supported by 38 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14), T10377_T5 (SEQ ID NO:15), T10377_T6 (SEQ ID NO:16) and T10377_T7 (SEQ ID NO:17). Table 18 below describes the starting and ending position of this segment on each transcript.

TABLE 18

Segment location on transcripts

| Transcript name | Segment starting position | Segment ending position |
| --- | --- | --- |
| T10377_T0 (SEQ ID NO: 12) | 818 | 943 |
| T10377_T1 (SEQ ID NO: 13) | 799 | 924 |
| T10377_T2 (SEQ ID NO: 14) | 903 | 1028 |
| T10377_T5 (SEQ ID NO: 15) | 818 | 943 |
| T10377_T6 (SEQ ID NO: 16) | 818 | 943 |
| T10377_T7 (SEQ ID NO: 17) | 818 | 943 |

Segment cluster T10377_node_21 (SEQ ID NO:98) according to the present invention is supported by 42 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14), T10377_T5 (SEQ ID NO:15), T10377_T6 (SEQ ID NO:16) and T10377_T7 (SEQ ID NO:17). Table 19 below describes the starting and ending position of this segment on each transcript.

TABLE 19

Segment location on transcripts

| Transcript name | Segment starting position | Segment ending position |
| --- | --- | --- |
| T10377_T0 (SEQ ID NO: 12) | 944 | 1072 |
| T10377_T1 (SEQ ID NO: 13) | 925 | 1053 |
| T10377_T2 (SEQ ID NO: 14) | 1029 | 1157 |
| T10377_T5 (SEQ ID NO: 15) | 944 | 1072 |
| T10377_T6 (SEQ ID NO: 16) | 944 | 1072 |
| T10377_T7 (SEQ ID NO: 17) | 944 | 1072 |

Segment cluster T10377_node_27 (SEQ ID NO:99) according to the present invention is supported by 1 libraries. The number of libraries was determined as previously described. This segment can be found in the following transcript(s): T10377_T7 (SEQ ID NO:17). Table 20 below describes the starting and ending position of this segment on each transcript.

TABLE 20

Segment location on transcripts

| Transcript name | Segment starting position | Segment ending position |
| --- | --- | --- |
| T10377_T7 (SEQ ID NO: 17) | 1259 | 1418 |

Segment cluster T10377_node_33 (SEQ ID NO:100) according to the present invention is supported by 103 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14), T10377_T5 (SEQ ID NO:15) and T10377_T6 (SEQ ID NO:16). Table 21 below describes the starting and ending position of this segment on each transcript.

TABLE 21

Segment location on transcripts

| Transcript name | Segment starting position | Segment ending position |
| --- | --- | --- |
| T10377_T0 (SEQ ID NO: 12) | 1444 | 2412 |
| T10377_T1 (SEQ ID NO: 13) | 1425 | 2393 |
| T10377_T2 (SEQ ID NO: 14) | 1529 | 2497 |
| T10377_T5 (SEQ ID NO: 15) | 1360 | 2328 |
| T10377_T6 (SEQ ID NO: 16) | 1343 | 2311 |

According to an optional embodiment of the present invention, short segments related to the above cluster are also provided. These segments are up to about 120 bp in length, and so are included in a separate description.

Segment cluster T10377_node_12 (SEQ ID NO:101) according to the present invention is supported by 35 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14), T10377_T5 (SEQ ID NO:15), T10377_T6 (SEQ ID NO:16) and T10377_T7 (SEQ ID NO:17). Table 22 below describes the starting and ending position of this segment on each transcript.

TABLE 22

Segment location on transcripts

| Transcript name | Segment starting position | Segment ending position |
| --- | --- | --- |
| T10377_T0 (SEQ ID NO: 12) | 458 | 550 |
| T10377_T1 (SEQ ID NO: 13) | 439 | 531 |
| T10377_T2 (SEQ ID NO: 14) | 543 | 635 |
| T10377_T5 (SEQ ID NO: 15) | 458 | 550 |
| T10377_T6 (SEQ ID NO: 16) | 458 | 550 |
| T10377_T7 (SEQ ID NO: 17) | 458 | 550 |

Segment cluster T10377_node_14 (SEQ ID NO:102) according to the present invention is supported by 28 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14), T10377_T5

(SEQ ID NO:15), T10377_T6 (SEQ ID NO:16) and T10377_T7 (SEQ ID NO:17). Table 23 below describes the starting and ending position of this segment on each transcript.

TABLE 23

Segment location on transcripts

| Transcript name | Segment starting position | Segment ending position |
|---|---|---|
| T10377_T0 (SEQ ID NO: 12) | 551 | 664 |
| T10377_T1 (SEQ ID NO: 13) | 532 | 645 |
| T10377_T2 (SEQ ID NO: 14) | 636 | 749 |
| T10377_T5 (SEQ ID NO: 15) | 551 | 664 |
| T10377_T6 (SEQ ID NO: 16) | 551 | 664 |
| T10377_T7 (SEQ ID NO: 17) | 551 | 664 |

Segment cluster T10377_node_16 (SEQ ID NO:103) according to the present invention can be found in the following transcript(s): T10377_T0 (SEQ ID NO:12), T10377_T1 (SEQ ID NO:13), T10377_T2 (SEQ ID NO:14), T10377_T5 (SEQ ID NO:15), T10377_T6 (SEQ ID NO:16) and T10377_T7 (SEQ ID NO:17). Table 24 below describes the starting and ending position of this segment on each transcript.

TABLE 24

Segment location on transcripts

| Transcript name | Segment starting position | Segment ending position |
|---|---|---|
| T10377_T0 (SEQ ID NO: 12) | 665 | 684 |
| T10377_T1 (SEQ ID NO: 13) | 646 | 665 |
| T10377_T2 (SEQ ID NO: 14) | 750 | 769 |
| T10377_T5 (SEQ ID NO: 15) | 665 | 684 |
| T10377_T6 (SEQ ID NO: 16) | 665 | 684 |
| T10377_T7 (SEQ ID NO: 17) | 665 | 684 |

Segment cluster T10377_node_2 (SEQ ID NO:104) according to the present invention is supported by 3 libraries. The number of libraries was determined as previously described. This segment can be found in the following transcript(s): T10377_T1 (SEQ ID NO:13). Table 25 below describes the starting and ending position of this segment on each transcript.

TABLE 25

Segment location on transcripts

| Transcript name | Segment starting position | Segment ending position |
|---|---|---|
| T10377_T1 (SEQ ID NO: 13) | 1 | 110 |

Segment cluster T10377_node_23 (SEQ ID NO:105) according to the present invention is supported by 44 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14), T10377_T5 (SEQ ID NO:15), T10377_T6 (SEQ ID NO:16) and T10377_T7 (SEQ ID NO:17). Table 26 below describes the starting and ending position of this segment on each transcript.

TABLE 26

Segment location on transcripts

| Transcript name | Segment starting position | Segment ending position |
|---|---|---|
| T10377_T0 (SEQ ID NO: 12) | 1073 | 1152 |
| T10377_T1 (SEQ ID NO: 13) | 1054 | 1133 |
| T10377_T2 (SEQ ID NO: 14) | 1158 | 1237 |
| T10377_T5 (SEQ ID NO: 15) | 1073 | 1152 |
| T10377_T6 (SEQ ID NO: 16) | 1073 | 1152 |
| T10377_T7 (SEQ ID NO: 17) | 1073 | 1152 |

Segment cluster T10377_node_25 (SEQ ID NO:106) according to the present invention is supported by 50 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14), T10377_T5 (SEQ ID NO:15), T10377_T6 (SEQ ID NO:16) and T10377_T7 (SEQ ID NO:17). Table 27 below describes the starting and ending position of this segment on each transcript.

TABLE 27

Segment location on transcripts

| Transcript name | Segment starting position | Segment ending position |
|---|---|---|
| T10377_T0 (SEQ ID NO: 12) | 1153 | 1258 |
| T10377_T1 (SEQ ID NO: 13) | 1134 | 1239 |
| T10377_T2 (SEQ ID NO: 14) | 1238 | 1343 |
| T10377_T5 (SEQ ID NO: 15) | 1153 | 1258 |
| T10377_T6 (SEQ ID NO: 16) | 1153 | 1258 |
| T10377_T7 (SEQ ID NO: 17) | 1153 | 1258 |

Segment cluster T10377_node_29 (SEQ ID NO:107) according to the present invention is supported by 50 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14) and T10377_T6 (SEQ ID NO:16). Table 28 below describes the starting and ending position of this segment on each transcript.

TABLE 28

Segment location on transcripts

| Transcript name | Segment starting position | Segment ending position |
|---|---|---|
| T10377_T0 (SEQ ID NO: 12) | 1259 | 1342 |
| T10377_T1 (SEQ ID NO: 13) | 1240 | 1323 |
| T10377_T2 (SEQ ID NO: 14) | 1344 | 1427 |
| T10377_T6 (SEQ ID NO: 16) | 1259 | 1342 |

Segment cluster T10377_node_3 (SEQ ID NO:108) according to the present invention is supported by 4 libraries. The number of libraries was determined as previously described. This segment can be found in the following transcript(s): T10377_T1 (SEQ ID NO:13) and T10377_T2 (SEQ ID NO:14). Table 29 below describes the starting and ending position of this segment on each transcript.

TABLE 29

Segment location on transcripts

| Transcript name | Segment starting position | Segment ending position |
|---|---|---|
| T10377_T1 (SEQ ID NO: 13) | 111 | 195 |
| T10377_T2 (SEQ ID NO: 14) | 215 | 299 |

Segment cluster T10377_node_31 (SEQ ID NO:109) according to the present invention is supported by 52 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14) and T10377_T5 (SEQ ID NO:15). Table 30 below describes the starting and ending position of this segment on each transcript.

TABLE 30

Segment location on transcripts

| Transcript name | Segment starting position | Segment ending position |
|---|---|---|
| T10377_T0 (SEQ ID NO: 12) | 1343 | 1443 |
| T10377_T1 (SEQ ID NO: 13) | 1324 | 1424 |
| T10377_T2 (SEQ ID NO: 14) | 1428 | 1528 |
| T10377_T5 (SEQ ID NO: 15) | 1259 | 1359 |

Segment cluster T10377_node_5 (SEQ ID NO:110) according to the present invention is supported by 30 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14), T10377_T5 (SEQ ID NO:15), T10377_T6 (SEQ ID NO:16) and T10377_T7 (SEQ ID NO:17). Table 31 below describes the starting and ending position of this segment on each transcript.

TABLE 31

Segment location on transcripts

| Transcript name | Segment starting position | Segment ending position |
|---|---|---|
| T10377_T0 (SEQ ID NO: 12) | 215 | 301 |
| T10377_T1 (SEQ ID NO: 13) | 196 | 282 |
| T10377_T2 (SEQ ID NO: 14) | 300 | 386 |
| T10377_T5 (SEQ ID NO: 15) | 215 | 301 |
| T10377_T6 (SEQ ID NO: 16) | 215 | 301 |
| T10377_T7 (SEQ ID NO: 17) | 215 | 301 |

Segment cluster T10377_node_8 (SEQ ID NO:111) according to the present invention is supported by 35 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14), T10377_T5 (SEQ ID NO:15), T10377_T6 (SEQ ID NO:16) and T10377_T7 (SEQ ID NO:17). Table 32 below describes the starting and ending position of this segment on each transcript.

TABLE 32

Segment location on transcripts

| Transcript name | Segment starting position | Segment ending position |
|---|---|---|
| T10377_T0 (SEQ ID NO: 12) | 302 | 407 |
| T10377_T1 (SEQ ID NO: 13) | 283 | 388 |
| T10377_T2 (SEQ ID NO: 14) | 387 | 492 |
| T10377_T5 (SEQ ID NO: 15) | 302 | 407 |
| T10377_T6 (SEQ ID NO: 16) | 302 | 407 |
| T10377_T7 (SEQ ID NO: 17) | 302 | 407 |

Segment cluster T10377_node_9 (SEQ ID NO:112) according to the present invention is supported by 35 libraries. The number of libraries was determined as previously described. This segment can be found in the following transcript(s): T10377_T0 (SEQ ID NO:12), T10377_T1 (SEQ ID NO:13), T10377_T2 (SEQ ID NO:14), T10377_T5 (SEQ ID NO:15), T10377_T6 (SEQ ID NO:16) and T10377_T7 (SEQ ID NO:17). Table 33 below describes the starting and ending position of this segment on each transcript.

TABLE 33

Segment location on transcripts

| Transcript name | Segment starting position | Segment ending position |
|---|---|---|
| T10377_T0 (SEQ ID NO: 12) | 408 | 457 |
| T10377_T1 (SEQ ID NO: 13) | 389 | 438 |
| T10377_T2 (SEQ ID NO: 14) | 493 | 542 |
| T10377_T5 (SEQ ID NO: 15) | 408 | 457 |
| T10377_T6 (SEQ ID NO: 16) | 408 | 457 |
| T10377_T7 (SEQ ID NO: 17) | 408 | 457 |

Alignment of: T10377_P2 (SEQ ID NO:292) xQ96NF5 (SEQ ID NO:362)

| Alignment segment 1/1: | | | |
|---|---|---|---|
| Quality: | 4288.00 | Escore: | 0 |
| Matching length: | 441 | Total length: | 441 |
| Matching Percent Similarity: | 99.77 | Matching Percent Identity: | 99.77 |
| Total Percent Similarity: | 99.77 | Total Percent Identity: | 99.77 |
| Gaps: | 0 | | |

Alignment:

```
11  ANVCRLRLTVPPESPVPEQCEKKIERKEQLLDLSNGEPTRKLPQGVVYGV   60
    ||||||||||||||||||||||||||||||||||||||||||||||||||
26  ANVCRLRLTVPPESPVPEQCEKKIERKEQLLDLSNGEPTRKLPQGVVYGV   75

61  VRRSDQNQQKEMVVYGWSTSQLKEEMNYIKDVRATLEKVRKRMYGDYDEM  110
    ||||||||||||||||||||||||||||||||||||||||||||||||||
76  VRRSDQNQQKEMVVYGWSTSQLKEEMNYIKDVRATLEKVRKRMYGDYDEM  125
```

-continued

```
111  RQKIRQLTQELSVSHAQQEYLENHIQTQSSALDRFNAMNSALASDSIGLQ  160
     ||||||||||||||||||||||||||||||||||||||||||||||||||
126  RQKIRQLTQELSVSHAQQEYLENHIQTQSSALDRFNAMNSALASDSIGLQ  175

161  KTLVDVTLENSNIKDQIRNLQQTYEASMDKLREKQRQLEVAQVENQLLKM  210
     ||||||||||||||||||||||||||||||||||||||||||||||||||
176  KTLVDVTLENSNIKDQIRNLQQTYEASMDKLREKQRQLEVAQVENQLLKM  225

211  KVESSQEANAEVMREMTKKLYSQYEEKLQEEQRKHSAEKEALLEETNSFL  260
     ||||||||||||||||||||||||||||||||||||||||||||||||||
226  KVESSQEANAEVMREMTKKLYSQYEEKLQEEQRKHSAEKEALLEETNSFL  275

261  KAIEEANKKMQAAEISLEEKDQRIGELDRLIERMEKERHQLQLQLLEHET  310
     | ||||||||||||||||||||||||||||||||||||||||||||||||
276  KVIEEANKKMQAAEISLEEKDQRIGELDRLIERMEKERHQLQLQLLEHET  325

311  EMSGELTDSDKERYQQLEEASASLRERIRHLDDMVHCQQKKVKQMVEEIE  360
     ||||||||||||||||||||||||||||||||||||||||||||||||||
326  EMSGELTDSDKERYQQLEEASASLRERIRHLDDMVHCQQKKVKQMVEEIE  375

361  SLKKKLQQKQLLILQLLEKISFLEGENNELQSRLDYLTETQAKTEVETRE  410
     ||||||||||||||||||||||||||||||||||||||||||||||||||
376  SLKKKLQQKQLLILQLLEKISFLEGENNELQSRLDYLTETQAKTEVETRE  425

411  IGVGCDLLPSQTGRTREIVMPSRNYTPYTRVLELTMKKTLT           451
     ||||||||||||||||||||||||||||||||||||||||
426  IGVGCDLLPSQTGRTREIVMPSRNYTPYTRVLELTMKKTLT           466
```

Alignment of: T10377_P5 (SEQ ID NO:293) xQ96NF 5 (SEQ ID NO:362)

| Alignment segment 1/1: | |
|---|---|
| Quality: | 4159.00 Escore: 0 |
| Matching length: | 438 Total length: 466 |

| Alignment segment 1/1: | | | |
|---|---|---|---|
| Matching Percent Similarity: | 99.77 | Matching Percent Identity: | 99.77 |
| Total Percent Similarity: | 93.78 | Total Percent Identity: | 93.78 |
| Gaps: | 1 | | |

Alignment:

```
1    MLRSTSTVTLLSGGAARTPGAPSRRANVCRLRLTVPPESPVPEQCEKKIE  50
     ||||||||||||||||||||||||||||||||||||||||||||||||||
1    MLRSTSTVTLLSGGAARTPGAPSRRANVCRLRLTVPPESPVPEQCEKKIE  50

51   RKEQLLDLSNGEPTRKLPQGVVYGVVRRSDQNQQKEMVVYGWSTSQLKEE  100
     ||||||||||||||||||||||||||||||||||||||||||||||||||
51   RKEQLLDLSNGEPTRKLPQGVVYGVVRRSDQNQQKEMVVYGWSTSQLKEE  100

101  MNYIKDVRATLEKVRKRMYGDYDEMRQKIRQLTQELSVSHAQQEYLENHI  150
     ||||||||||||||||||||||||||||||||||||||||||||||||||
101  MNYIKDVRATLEKVRKRMYGDYDEMRQKIRQLTQELSVSHAQQEYLENHI  150

151  QTQSSALDRFNAMNSALASDSIGLQKTLVDVTLENSNIKDQIRNLQQTYE  200
     ||||||||||||||||||||||||||||||||||||||||||||||||||
151  QTQSSALDRFNAMNSALASDSIGLQKTLVDVTLENSNIKDQIRNLQQTYE  200

201  ASMDKLREKQRQLEVAQVENQLLKMKVESSQEANAEVMREMTKKLYSQYE  250
     ||||||||||||||||||||||||||||||||||||||||||||||||||
201  ASMDKLREKQRQLEVAQVENQLLKMKVESSQEANAEVMREMTKKLYSQYE  250

251  EKLQEEQRKHSAEKEALLEETNSFLKAIEEANKKMQAAEISLEEKDQRIG  300
     ||||||||||||||||||||||||||||||||||||||||||||||||||
251  EKLQEEQRKHSAEKEALLEETNSFLKVIEEANKKMQAAEISLEEKDQRIG  300

301  ELDRLIERMEKERHQLQLQLLEHETEMSGELTDSDKERYQQLEEASASLR  350
     ||||||||||||||||||||||||||||||||||||||||||||||||||
301  ELDRLIERMEKERHQLQLQLLEHETEMSGELTDSDKERYQQLEEASASLR  350

351  ERIRHLDDMVHCQQKKVKQMVE............................  372
     |||||||||||||||||||||
351  ERIRHLDDMVHCQQKKVKQMVEEIESLKKKLQQKQLLILQLLEKISFLEG  400
```

```
373  ENNELQSRLDYLTETQAKTEVETREIGVGCDLLPSQTGRTREIVMPSRNY  422
     |||||||||||||||||||||||||||||||||||||||||||||||||
401  ENNELQSRLDYLTETQAKTEVETREIGVGCDLLPSQTGRTREIVMPSRNY  450

423  TPYTRVLELTMKKTLT  438
     ||||||||||||||||
451  TPYTRVLELTMKKTLT  466
```

Alignment of: T10377_P6 (SEQ ID NO:294) xQ96NF5 (SEQ ID NO:362)

| Alignment segment 1/1: | | | |
|---|---|---|---|
| Quality: | 3896.00 | Escore: | 0 |
| Matching length: | 403 | Total length: | 403 |
| Matching Percent Similarity: | 99.50 | Matching Percent Identity: | 99.50 |
| Total Percent Similarity: | 99.50 | Total Percent Identity: | 99.50 |
| Gaps: | 0 | | |

Alignment of: T10377_P7 (SEQ ID NO:295) xQ96NF5 (SEQ ID NO:362)

| Alignment segment 1/1: | | | |
|---|---|---|---|
| Quality: | 3642.00 | Escore: | 0 |
| Matching length: | 376 | Total length: | 376 |
| Matching Percent Similarity: | 99.47 | Matching Percent Identity: | 99.47 |
| Total Percent Similarity: | 99.47 | Total Percent Identity: | 99.47 |
| Gaps: | 0 | | |

Alignment:

```
  1  MLRSTSTVTLLSGGAARTPGAPSRRANVCRLRLTVPPESPVPEQCEKKIE   50
     ||||||||||||||||||||||||||||||||||||||||||||||||||
  1  MLRSTSTVTLLSGGAARTPGAPSRRANVCRLRLTVPPESPVPEQCEKKIE   50

51  RKEQLLDLSNGEPTRKLPQGVVYGVVRRSDQNQQKEMVVYGWSTSQLKEE  100
     |||||||||||||||||||||||||||||||||||||||||||||||||
 51  RKEQLLDLSNGEPTRKLPQGVVYGVVRRSDQNQQKEMVVYGWSTSQLKEE  100

101  MNYIKDVRATLEKVRKRMYGDYDEMRQKIRQLTQELSVSHAQQEYLENHI  150
     |||||||||||||||||||||||||||||||||||||||||||||||||
101  MNYIKDVRATLEKVRKRMYGDYDEMRQKIRQLTQELSVSHAQQEYLENHI  150

151  QTQSSALDRFNAMNSALASDSIGLQKTLVDVTLENSNIKDQIRNLQQTYE  200
     |||||||||||||||||||||||||||||||||||||||||||||||||
151  QTQSSALDRFNAMNSALASDSIGLQKTLVDVTLENSNIKDQIRNLQQTYE  200

201  ASMDKLREKQRQLEVAQVENQLLKMKVESSQEANAEVMREMTKKLYSQYE  250
     |||||||||||||||||||||||||||||||||||||||||||||||||
201  ASMDKLREKQRQLEVAQVENQLLKMKVESSQEANAEVMREMTKKLYSQYE  250

251  EKLQEEQRKHSAEKEALLEETNSFLKAIEEANKKMQAAEISLEEKDQRIG  300
     ||||||||||||||||||||||||||| |||||||||||||||||||||
251  EKLQEEQRKHSAEKEALLEETNSFLKVIEEANKKMQAAEISLEEKDQRIG  300

301  ELDRLIERMEKERHQLQLQLLEHETEMSGELTDSDKERYQQLEEASASLR  350
     |||||||||||||||||||||||||||||||||||||||||||||||||
301  ELDRLIERMEKERHQLQLQLLEHETEMSGELTDSDKERYQQLEEASASLR  350

351  ERIRHLDDMVHCQQKKVKQMVEEIESLKKKLQQKQLLILQLLEKISFLEG  400
     |||||||||||||||||||||||||||||||||||||||||||||||||
351  ERIRHLDDMVHCQQKKVKQMVEEIESLKKKLQQKQLLILQLLEKISFLEG  400

401  EPN  403
     | |
401  ENN  403
```

Alignment:

```
  1 MLRSTSTVTLLSGGAARTPGAPSRRANVCRLRLTVPPESPVPEQCEKKIE   50
    ||||||||||||||||||||||||||||||||||||||||||||||||||
  1 MLRSTSTVTLLSGGAARTPGAPSRRANVCRLRLTVPPESPVPEQCEKKIE   50

51 RKEQLLDLSNGEPTRKLPQGVVYGVVRRSDQNQQKEMVVYGWSTSQLKEE  100
    ||||||||||||||||||||||||||||||||||||||||||||||||||
 51 RKEQLLDLSNGEPTRKLPQGVVYGVVRRSDQNQQKEMVVYGWSTSQLKEE  100

101 MNYIKDVRATLEKVRKRMYGDYDEMRQKIRQLTQELSVSHAQQEYLENHI  150
    ||||||||||||||||||||||||||||||||||||||||||||||||||
101 MNYIKDVRATLEKVRKRMYGDYDEMRQKIRQLTQELSVSHAQQEYLENHI  150

151 QTQSSALDRFNAMNSALASDSIGLQKTLVDVTLENSNIKDQIRNLQQTYE  200
    ||||||||||||||||||||||||||||||||||||||||||||||||||
151 QTQSSALDRFNAMNSALASDSIGLQKTLVDVTLENSNIKDQIRNLQQTYE  200

201 ASMDKLREKQRQLEVAQVENQLLKMKVESSQEANAEVMREMTKKLYSQYE  250
    ||||||||||||||||||||||||||||||||||||||||||||||||||
201 ASMDKLREKQRQLEVAQVENQLLKMKVESSQEANAEVMREMTKKLYSQYE  250

251 EKLQEEQRKHSAEKEALLEETNSFLKAIEEANKKMQAAEISLEEKDQRIG  300
    |||||||||||||||||||||||||||| |||||||||||||||||||||
251 EKLQEEQRKHSAEKEALLEETNSFLKVIEEANKKMQAAEISLEEKDQRIG  300

301 ELDRLIERMEKERHQLQLQLLEHETEMSGELTDSDKERYQQLEEASASLR  350
    ||||||||||||||||||||||||||||||||||||||||||||||||||
301 ELDRLIERMEKERHQLQLQLLEHETEMSGELTDSDKERYQQLEEASASLR  350

351 ERIRHLDDMVHCQQKKVKQMVEEIMS                           376
    |||||||||||||||||||||||| |
351 ERIRHLDDMVHCQQKKVKQMVEEIES                           376
```

Alignment of: T10377_P8 (SEQ ID NO:296) xQ96NF5 (SEQ ID NO:362)

Alignment segment 1/1:

| | | | |
|---|---|---|---|
| Quality: | 4519.00 | Escore: | 0 |
| Matching length: | 465 | Total length: | 466 |
| Matching Percent Similarity: | 99 | Matching Percent Identity: | 99 |
| Total Percent Similarity: | 99 | Total Percent Identity: | 99 |
| Gaps: | 0 | | |

Alignment:

```
  1 MLRSTSTVTLLSGGAARTPGAPSRRANVCRLRLTVPPESPVPEQCEKKIE   50
    ||||||||||||||||||||||||||||||||||||||||||||||||||
  1 MLRSTSTVTLLSGGAARTPGAPSRRANVCRLRLTVPPESPVPEQCEKKIE   50

51 RKEQLLDLSNGEPTRKLPQGVVYGVVRRSDQNQQKEMVVYGWSTSQLKEE  100
    ||||||||||||||||||||||||||||||||||||||||||||||||||
 51 RKEQLLDLSNGEPTRKLPQGVVYGVVRRSDQNQQKEMVVYGWSTSQLKEE  100

101 MNYIKDVRATLEKVRKRMYGDYDEMRQKIRQLTQELSVSHAQQEYLENHI  150
    ||||||||||||||||||||||||||||||||||||||||||||||||||
101 MNYIKDVRATLEKVRKRMYGDYDEMRQKIRQLTQELSVSHAQQEYLENHI  150

151 QTQSSALDRFNAMNSALASDSIGLQKTLVDVTLENSNIKDQIRNLQQTYE  200
    ||||||||||||||||||||||||||||||||||||||||||||||||||
151 QTQSSALDRFNAMNSALASDSIGLQKTLVDVTLENSNIKDQIRNLQQTYE  200

201 ASMDKLREKQRQLEVAQVENQLLKMKVESSQEANAEVMREMTKKLYSQYE  250
    ||||||||||||||||||||||||||||||||||||||||||||||||||
201 ASMDKLREKQRQLEVAQVENQLLKMKVESSQEANAEVMREMTKKLYSQYE  250

251 EKLQEEQRKHSAEKEALLEETNSFLKAIEEANKKMQAAEISLEEKDQRIG  300
    |||||||||||||||||||||||||||| |||||||||||||||||||||
251 EKLQEEQRKHSAEKEALLEETNSFLKVIEEANKKMQAAEISLEEKDQRIG  300
```

```
301  ELDRLIERMEKERHQLQLQLLEHETEMSGELTDSDKERYQQLEEASASLR  350
     ||||||||||||||||||||||||||||||||||||||||||||||||||
301  ELDRLIERMEKERHQLQLQLLEHETEMSGELTDSDKERYQQLEEASASLR  350

351  ERIRHLDDMVHCQQKKVKQMVEEIESLKKKLQQKQLLILQLLEKISFLEG  400
     |||||||||||||||||||||||||||||||||||||||||||||||||
351  ERIRHLDDMVHCQQKKVKQMVEEIESLKKKLQQKQLLILQLLEKISFLEG  400

401  ENNELQSRLDYLTETQAKTEVETREIGVGCDLLPSQTGRTREIVMPSRNY  450
     |||||||||||||||||||||||||||||||||||||||||||||||||
401  ENNELQSRLDYLTETQAKTEVETREIGVGCDLLPSQTGRTREIVMPSRNY  450

451  TPYTRVLELTMKKTLT                                    466
     ||||||||||||||||
451  TPYTRVLELTMKKTLT                                    466
```

Expression of Q96NF5 Transcripts which are Detectable by amplicon as Depicted in Sequence Name T10377 Specifically in Heart Tissue.

Expression of Q96NF5 transcripts detectable by or according to junc25-31 node(s), T10377 amplicon(s) and T10377 junc25-31F (SEQ ID NO:363) and T10377 junc25-31R (SEQ ID NO:364) primers was measured by real time PCR. In parallel the expression of four housekeeping genes—RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)), Ubiquitin (GenBank Accession No. BC000449 (SEQ ID NO:445); amplicon—Ubiquitin-amplicon (SEQ ID NO:448)) and SDHA (GenBank Accession No. NM_004168 (SEQ ID NO:449); amplicon—SDHA-amplicon (SEQ ID NO:452)), was measured similarly. For each RT sample, the expression of the above amplicons was normalized to the geometric mean of the quantities of the housekeeping genes. The normalized quantity of each RT sample was then divided by the median of the quantities of the heart samples (Sample Nos. 44, 45, 46, Table 1, above "Tissue samples in testing panel"), to obtain a value of fold up-regulation for each sample relative to median of the heart.

Figure 12:
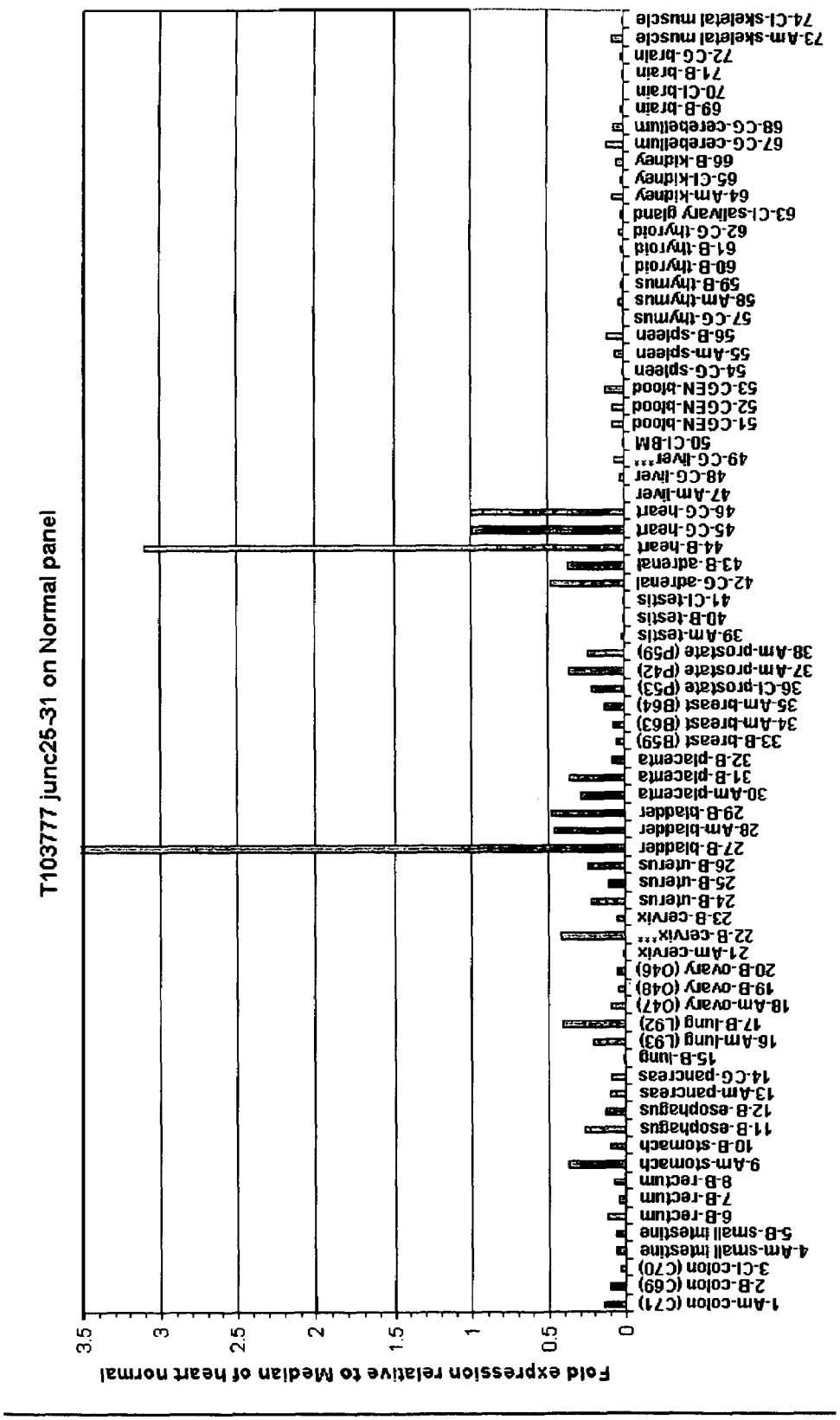
FIG. 12 is a histogram showing specific expression of Q96NF5 transcripts in sequence T10377 in heart tissue samples (SEQ ID NO:365).

FIG. 12 is a histogram showing specific expression of the above-indicated Q96NF5 transcripts in heart tissue samples as opposed to other tissues.

As is evident from FIG. 12, the expression of Q96NF5 transcripts detectable by the above amplicon(s) in heart tissue samples was significantly higher than in most other samples (non-heart tissue sample Nos. 1-26, 28-43 47-74 Table 1, above "Tissue samples in testing panel").

Primer pairs are also optionally and preferably encompassed within the present invention; for example, for the above experiment, the following primer pair was used as a non-limiting illustrative example only of a suitable primer pair: T10377 junc25-31F (SEQ ID NO:363) forward primer; and T10377 junc25-31R (SEQ ID NO:364) reverse primer.

The present invention also preferably encompasses any amplicon obtained through the use of any suitable primer pair; for example, for the above experiment, the following amplicon was obtained as a non-limiting illustrative example only of a suitable amplicon: T10377 junc25-31 (SEQ ID NO:365).

T10377junc25-31F (SEQ ID NO:363):
AGCAGATGGTCGAGGAGAATAATG

T10377junc25-31R (SEQ ID NO:364):
ATCTCTCTGGTTTCCACTTCGG

T10377junc25-31 (SEQ ID NO:365):
AGCAGATGGTCGAGGAGAATAATGAACTACAAAGCAGGTTGGACTATTT
AACAGAAACCCAGGCCAAGACCGAAGTGGAAACCAGAGAGAT Expression of Q96NF5 transcripts detectable by or according to junc29-33 node(s), T10377 amplicon(s) and T10377 junc29-33F (SEQ ID NO:366) and T10377 junc29-33R (SEQ ID NO:367) primers was measured by real time PCR. In parallel the expression of four housekeeping genes—RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)), Ubiquitin (GenBank Accession No. BC000449 (SEQ ID NO:445); amplicon—Ubiquitin-amplicon (SEQ ID NO:448)) and SDHA (GenBank Accession No. NM_004168 (SEQ ID NO:449); amplicon—SDHA-amplicon (SEQ ID NO:452)), was measured similarly. For each RT sample, the expression of the above amplicons was normalized to the geometric mean of the quantities of the housekeeping genes. The normalized quantity of each RT sample was then divided by the median of the quantities of the heart samples (Sample Nos. 44, 45, 46, Table 1, above "Tissue samples in testing panel"), to obtain a value of fold up-regulation for each sample relative to median of the heart.

Figure 13:
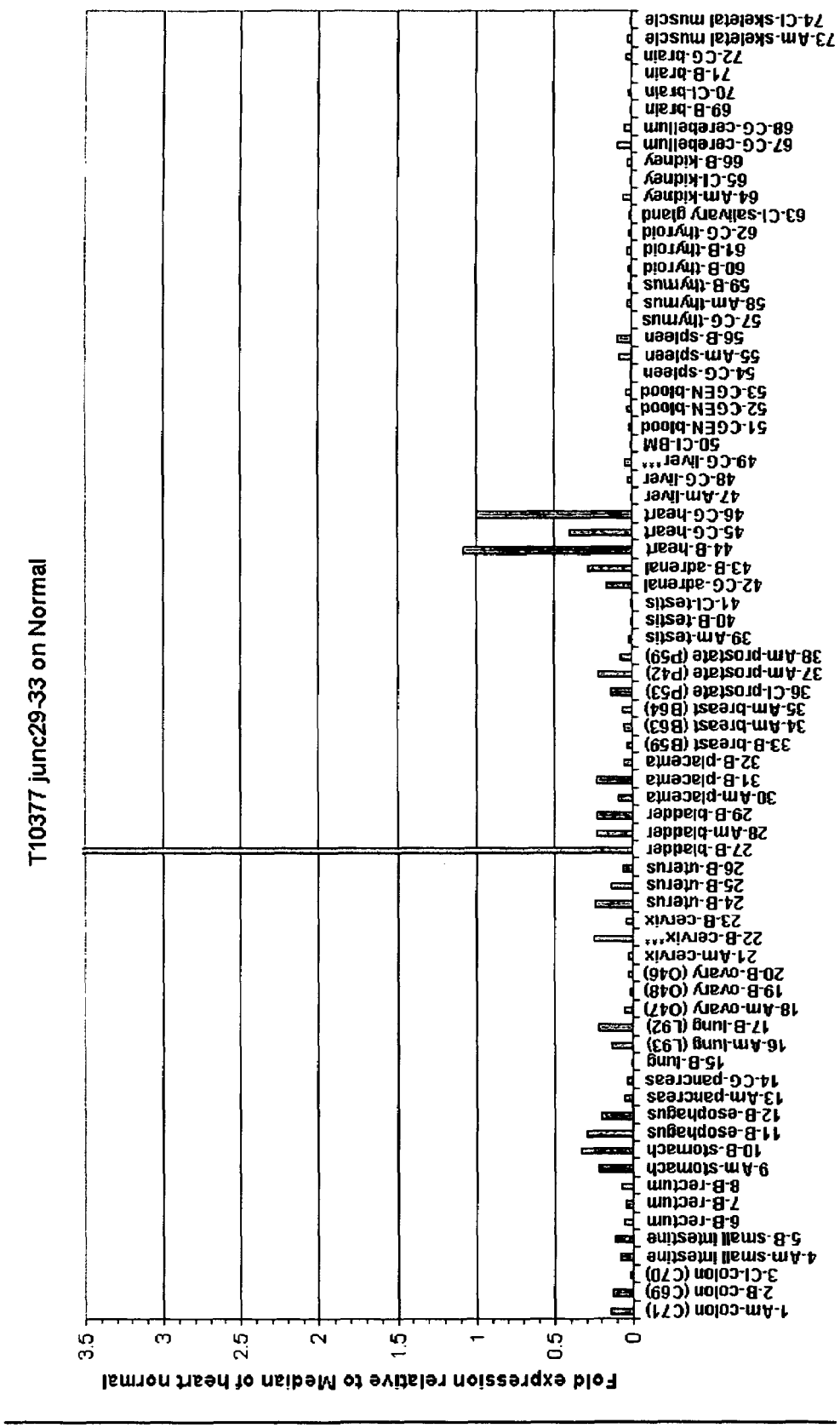
FIG. 13 is a histogram showing specific expression of the Q96NF5 transcripts in sequence T10377 junc29-33 (SEQ ID NO:368) heart tissue samples.

FIG. 13 is a histogram showing specific expression of the above-indicated Q96NF5 transcripts in heart tissue samples as opposed to other tissues.

As is evident from FIG. 13, the expression of Q96NF5 transcripts detectable by the above amplicon(s) in heart tissue samples was significantly higher than in most other samples (non-heart tissue sample Nos. 1-26, 28-43, 47-74 Table 1 above "Tissue samples in testing panel").

Primer pairs are also optionally and preferably encompassed within the present invention; for example, for the above experiment, the following primer pair was used as a non-limiting illustrative example only of a suitable primer pair: T10377 junc29-33F (SEQ ID NO:366) forward primer; and T10377 junc29-33R (SEQ ID NO:367) reverse primer.

The present invention also preferably encompasses any amplicon obtained through the use of any suitable primer pair; for example, for the above experiment, the following amplicon was obtained as a non-limiting illustrative example only of a suitable amplicon: T10377 junc29-33 (SEQ ID NO:368).

T10377 junc29-33F (SEQ ID NO:366):
CTTTCTTAGAAGGAGAGCCAAACAG

T10377 junc29-33R (SEQ ID NO:367):
CCTAAGTCAGAGTTTTCTTCATGGTTAAC

T10377 junc29-33 (SEQ ID NO:368):
CTTTCTTAGAAGGAGAGCCAAACAGGCAGGACTCGTGAAATTGTGATGCC
TTCTAGGAACTACACCCCATACACAAGAGTCCTGGAGTTAACCATGAAG
AAAACTCTGACTTAGG Expression of Q96NF5 transcripts detectable by or according to seg2-3 node(s), T10377 amplicon(s) and T10377 seg2-3F (SEQ ID NO:369) and T10377 seg2-3R (SEQ ID NO:370) primers was measured by real time PCR. In parallel the expression of four housekeeping genes— RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)), Ubiquitin (GenBank Accession No. BC000449 (SEQ ID NO:445); amplicon— Ubiquitin-amplicon (SEQ ID NO:448)) and SDHA (GenBank Accession No. NM_004168 (SEQ ID NO:449); amplicon—SDHA-amplicon (SEQ ID NO:452)), was measured similarly. For each RT sample, the expression of the above amplicons was normalized to the geometric mean of the quantities of the housekeeping genes. The normalized quantity of each RT sample was then divided by the median of the quantities of the heart samples (Sample Nos. 44, 45, 46, Table 1, above "Tissue samples in testing panel"), to obtain a value of fold up-regulation for each sample relative to median of the heart.

Figure 14:
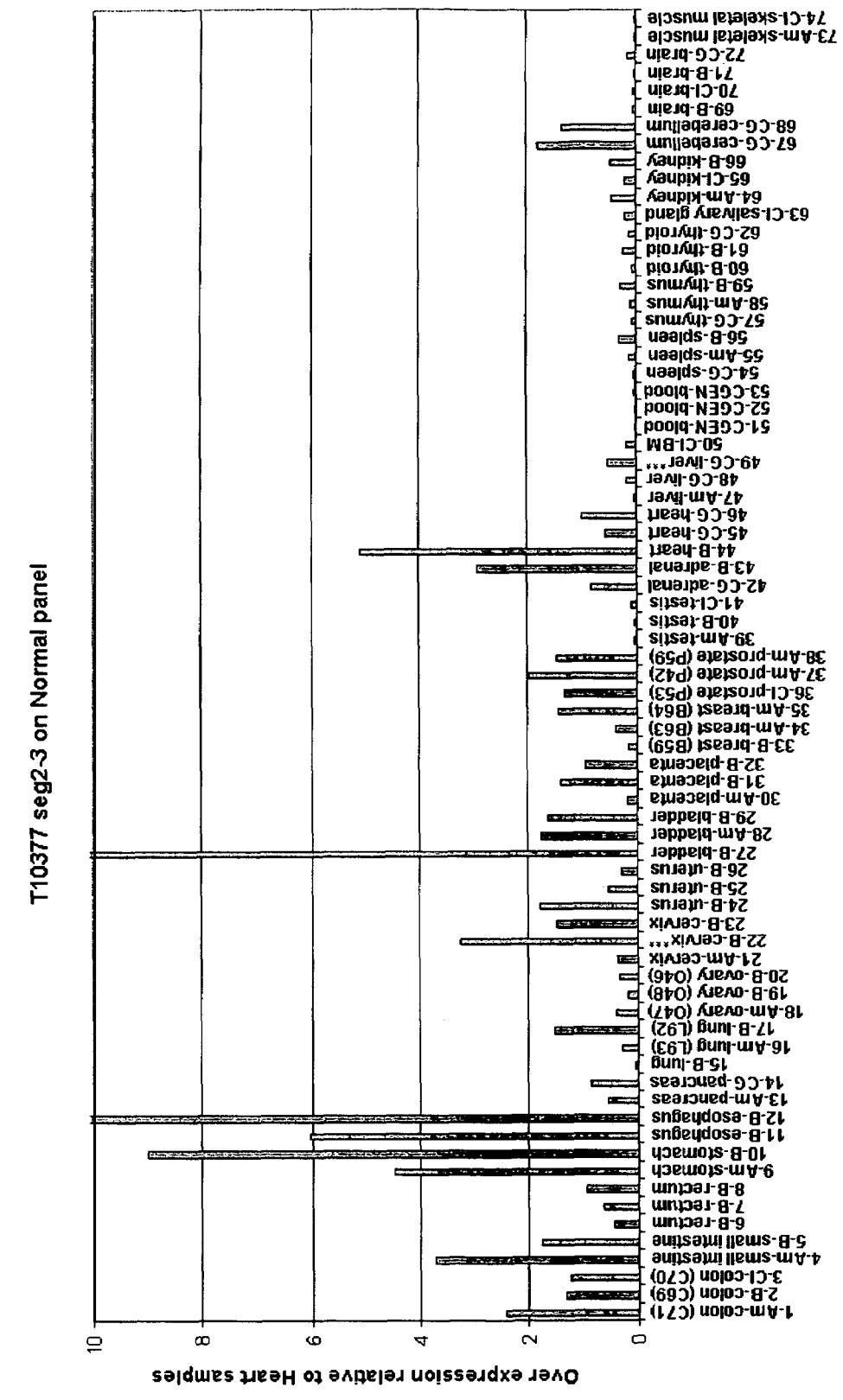
FIG. 14 is a histogram showing specific expression of the above-indicated Q96NF5 transcripts T10377 seg2-3 (SEQ ID NO:371) in heart tissue samples.

FIG. 14 is a histogram showing specific expression of the above-indicated Q96NF5 transcripts in heart tissue samples as opposed to other tissues.

As is evident from FIG. 14, the expression of Q96NF5 transcripts detectable by the above amplicon(s) in heart tissue samples was significantly higher than in the skeletal muscle (non-heart tissue sample Nos. 1-9,13-26, 28-43, 47-74 Table 1, "Tissue samples in testing samples").

Primer pairs are also optionally and preferably encompassed within the present invention; for example, for the above experiment, the following primer pair was used as a non-limiting illustrative example only of a suitable primer pair: T10377 seg2-3F (SEQ ID NO:369) forward primer; and T10377 seg2-3R (SEQ ID NO:370) reverse primer.

The present invention also preferably encompasses any amplicon obtained through the use of any suitable primer pair; for example, for the above experiment, the following amplicon was obtained as a non-limiting illustrative example only of a suitable amplicon: T10377 seg2-3 (SEQ ID NO:371).

T10377 seg2-3F (SEQ ID NO:369):
CTTCGCATTGTGCATAACACAA

T10377 seg2-3R (SEQ ID NO:370):
GAAACTCGGATACACAATCTCCAGA

T10377 seg2-3 (SEQ ID NO:371):
CTTCGCATTGTGCATAACACAAGCCCTGAACCAGCTGCTTTGGGAACCCC
TGGGAATAAAGTGCCCTACCTGCCTTTCAGGCACTGCCAAGCCTGGGCA
TCTCTGGAGATTGTGTATCCGAGTTTC Description for Cluster Z24874

Cluster Z24874 features 2 transcript(s) and 10 segment(s) of interest, the names for which are given in Tables 1 and 2, respectively, the sequences themselves are given at the end of the application. The selected protein variants are given in table 3.

TABLE 1

Transcripts of interest

| Transcript Name | Seq ID No. |
|---|---|
| Z24874_PEA_2_T10 | 18 |
| Z24874_PEA_2_T11 | 19 |

TABLE 2

Segments of interest

| Segment Name | Seq ID No. |
|---|---|
| Z24874_PEA_2_node_21 | 113 |
| Z24874_PEA_2_node_4 | 114 |
| Z24874_PEA_2_node_0 | 115 |
| Z24874_PEA_2_node_10 | 116 |
| Z24874_PEA_2_node_12 | 117 |
| Z24874_PEA_2_node_13 | 118 |
| Z24874_PEA_2_node_14 | 119 |
| Z24874_PEA_2_node_16 | 120 |
| Z24874_PEA_2_node_3 | 121 |
| Z24874_PEA_2_node_6 | 122 |

TABLE 3

Proteins of interest

| Protein Name | Seq ID No. |
|---|---|
| Z24874_PEA_2_P5 | 297 |
| Z24874_PEA_2_P6 | 298 |

The heart-selective diagnostic marker prediction engine provided the following results with regard to cluster Z24874. Predictions were made for selective expression of transcripts of this cluster in heart tissue, according to the previously described methods. The numbers on the y-axis of FIG. 15 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 15, concerning the number of heart-specific clones in libraries/sequences; as well as with regard to the histogram in FIG. 16, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 16.7; the ratio of expression of the cluster in heart specific ESTs to the overall expression of the cluster in muscle-specific ESTs which was found to be 2.1; and fisher exact test P-values were computed both for library and weighted clone counts to check that the counts are statistically significant, and were found to be 3.20 E-09.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 2.1, which clearly supports specific expression in heart tissue.

As noted above, cluster Z24874 features 2 transcript(s), which were listed in Table 1 above. A description of each variant protein according to the present invention is now provided.

Variant protein Z24874_PEA_2_P5 (SEQ ID NO:297) according to the present invention has an amino acid sequence as given at the end of the application; it is encoded by transcript(s) Z24874_PEA_2_T10 (SEQ ID NO:18). One or more alignments to one or more previously published protein sequences are given at the end of the application. A brief description of the relationship of the variant protein according to the present invention to each such aligned protein is as follows:

Comparison report between Z24874_PEA_2_P5 (SEQ ID NO:297) and Q9NPI5 (SEQ ID NO:372):

1. An isolated chimeric polypeptide encoding for Z24874_PEA_2_P5 (SEQ ID NO:297), comprising a first amino acid sequence being at least 90% homologous to MKLIVGIGGMTNGGKTTLTNSLLRALP-NCCVIHQDDFFKPQDQIAVGEDGFKQWDVLE SLD-MEAMLDTVQAWLSSPQKFARAHGVSVQ-PEASDTHILLLEGFLLYSYKPLVDLYSR RYFLTVPYEECKWRRS corresponding to amino acids 1-132 of Q9NPI5 (SEQ ID NO:372), which also corresponds to amino acids 1-132 of Z24874_PEA_2_P5 (SEQ ID NO:297), and a second amino acid sequence being at least 70%, optionally at least 80%, preferably at least 85%, more preferably at least 90% and most preferably at least 95% homologous to a polypeptide having the sequence LPGRHEVPRGALP (SEQ ID NO:409) corresponding to amino acids 133-145 of Z24874_PEA_2_P5 (SEQ ID NO:297), wherein said first and second amino acid sequences are contiguous and in a sequential order.

2. An isolated polypeptide encoding for a tail of Z24874_PEA_2_P5 (SEQ ID NO:297), comprising a polypeptide being at least 70%, optionally at least about 80%, preferably at least about 85%, more preferably at least about 90% and most preferably at least about 95% homologous to the sequence LPGRHEVPRGALP (SEQ ID NO:409) in Z24874_PEA_2_P5 (SEQ ID NO:297).

Comparison report between Z24874_PEA_2_P5 (SEQ ID NO:297) and Q9NZK3 (SEQ ID NO:373):

1. An isolated chimeric polypeptide encoding for Z24874_PEA_2_P5 (SEQ ID NO:297), comprising a first amino acid sequence being at least 90% homologous to MKLIVGIGGMTNGGKTTLTNSLLRALP-NCCVIHQDDFFKPQDQIAVGEDGFKQWDVLE SLD-MEAMLDTVQAWLSSPQKFARAHGVSVQ-PEASDTHILLLEGFLLYSYKP corresponding to amino acids 1-109 of Q9NZK3 (SEQ ID NO:373), which also corresponds to amino acids 1-109 of Z24874_PEA_2_P5 (SEQ ID NO:297), and a second amino acid sequence being at least 70%, optionally at least 80%, preferably at least 85%, more preferably at least 90% and most preferably at least 95% homologous to a polypeptide having the sequence LVDLYSRRYFLTVPYEECKWRRSLPGRHEVPRGALP corresponding to amino acids 110-145 of Z24874_PEA_2_P5 (SEQ ID NO:297), wherein said first and second amino acid sequences are contiguous and in a sequential order.

2. An isolated polypeptide encoding for a tail of Z24874_PEA_2_P5 (SEQ ID NO:297), comprising a polypeptide being at least 70%, optionally at least about 80%, preferably at least about 85%, more preferably at least about 90% and most preferably at least about 95% homologous to the sequence LVDLYSRRYFLTVPYEECK-WRRSLPGRHEVPRGALP in Z24874_PEA_2_P5 (SEQ ID NO:297).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein Z24874_PEA_2_P5 (SEQ ID NO:297) is encoded by the following transcript(s): Z24874_PEA_2_T10 (SEQ ID NO:18), for which the sequence(s) is/are given at the end of the application. The coding portion of transcript Z24874_PEA_2_T10 (SEQ ID NO:18) is shown in bold; this coding portion starts at position 292 and ends at position 726. The transcript also has the following SNPs as listed in Table 4 (given according to their position on the nucleotide sequence, with the alternative nucleic acid listed; the last column indicates whether the SNP is known or not; the presence of known SNPs in variant protein Z24874_PEA_2_P5 (SEQ ID NO:297) sequence provides support for the deduced sequence of this variant protein according to the present invention).

TABLE 4

| Nucleic acid SNPs | | |
|---|---|---|
| SNP position on nucleotide sequence | Alternative nucleic acid | Previously known SNP? |
| 1 | G -> C | No |
| 70 | G -> A | Yes |
| 504 | C -> T | No |
| 645 | C -> T | Yes |
| 954 | C -> T | Yes |

Variant protein Z24874_PEA_2_P6 (SEQ ID NO:298) according to the present invention has an amino acid sequence as given at the end of the application; it is encoded by transcript(s) Z24874_PEA_2_T11 (SEQ ID NO:19). One or more alignments to one or more previously published protein sequences are given at the end of the application. A brief description of the relationship of the variant protein according to the present invention to each such aligned protein is as follows:

Comparison report between Z24874_PEA_2_P6 (SEQ ID NO:298) and Q9NPI5 (SEQ ID NO:372):

1. An isolated chimeric polypeptide encoding for Z24874_PEA_2_P6 (SEQ ID NO:298), comprising a first amino acid sequence being at least 90% homologous to MKLIVGIGGMTNGGKTTLTNSLLRALP-NCCVIHQDDFFKPQDQIAVGEDGFKQWDVLE SLD-MEAMLDTVQAWLSSPQKFARAHGVSVQ-PEASDTHILLLEGFLLYSY corresponding to amino acids 1-107 of Q9NP15 (SEQ ID NO:372), which also corresponds to amino acids 1-107 of Z24874_PEA_2_P6 (SEQ ID NO:298), and a second amino acid sequence being at least 70%, optionally at least 80%, preferably at least 85%, more preferably at least 90% and most preferably at least 95% homologous to a polypeptide having the sequence NLPGRHEVPRGALP (SEQ ID NO:410) corresponding to amino acids 108-121 of Z24874_PEA_2_P6 (SEQ ID NO:298), wherein said first and second amino acid sequences are contiguous and in a sequential order.

2. An isolated polypeptide encoding for a tail of Z24874_PEA_2_P6 (SEQ ID NO:298), comprising a polypeptide being at least 70%, optionally at least about 80%, preferably at least about 85%, more preferably at least about 90% and most preferably at least about 95% homologous to the sequence NLPGRHEVPRGALP (SEQ ID NO:410) in Z24874_PEA_2_P6 (SEQ ID NO:298).

Comparison report between Z24874_PEA_2_P6 (SEQ ID NO:298) and Q9NZK3 (SEQ ID NO:373):

1. An isolated chimeric polypeptide encoding for Z24874_PEA_2_P6 (SEQ ID NO:298), comprising a first amino acid sequence being at least 90% homologous to MKLIVGIGGMTNGGKTTLTNSLLRALP-NCCVIHQDDFFKPQDQIAVGEDGFKQWDVLE SLD-MEAMLDTVQAWLSSPQKFARAHGVSVQ-PEASDTHILLLEGFLLYSY corresponding to amino acids 1-107 of Q9NZK3 (SEQ ID NO:373), which also corresponds to amino acids 1-107 of Z24874_PEA_2_P6 (SEQ ID NO:298), and a second amino acid sequence being at least 70%, optionally at least 80%, preferably at least 85%, more preferably at least 90% and most preferably at least 95% homologous to a polypeptide having the sequence NLPGRHEVPRGALP (SEQ ID NO:410) corresponding to amino acids 108-121 of Z24874_PEA_2_P6 (SEQ ID NO:298), wherein said first and second amino acid sequences are contiguous and in a sequential order.

2. An isolated polypeptide encoding for a tail of Z24874_PEA_2_P6 (SEQ ID NO:298), comprising a polypeptide being at least 70%, optionally at least about 80%, preferably at least about 85%, more preferably at least about 90% and most preferably at least about 95% homologous to the sequence NLPGRHEVPRGALP (SEQ ID NO:410) in Z24874_PEA_2_P6 (SEQ ID NO:298).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein Z24874_PEA_2_P6 (SEQ ID NO:298) is encoded by the following transcript(s): Z24874_PEA_2_T11 (SEQ ID NO:19), for which the sequence(s) is/are given at the end of the application. The coding portion of transcript Z24874_PEA_2_T11 (SEQ ID NO:19) is shown in bold; this coding portion starts at position 292 and ends at position 654. The transcript also has the following SNPs as listed in Table 5 (given according to their position on the nucleotide sequence, with the alternative nucleic acid listed; the last column indicates whether the SNP is known or not; the presence of known SNPs in variant protein Z24874_PEA_2_P6 (SEQ ID NO:298) sequence provides support for the deduced sequence of this variant protein according to the present invention).

TABLE 5

Nucleic acid SNPs

| SNP position on nucleotide sequence | Alternative nucleic acid | Previously known SNP? |
|---|---|---|
| 1 | G -> C | No |
| 70 | G -> A | Yes |
| 504 | C -> T | No |
| 882 | C -> T | Yes |

As noted above, cluster Z24874 features 10 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z24874_PEA_2_node_21 (SEQ ID NO:113) according to the present invention is supported by 30 libraries. The number of libraries was determined as previously described. This segment can be found in the following transcript(s): Z24874_PEA_2_T10 (SEQ ID NO:18) and Z24874_PEA_2_T11 (SEQ ID NO:19). Table 6 below describes the starting and ending position of this segment on each transcript.

TABLE 6

Segment location on transcripts

| Transcript name | Segment starting position | Segment ending position |
|---|---|---|
| Z24874_PEA_2_T10 (SEQ ID NO: 18) | 687 | 1027 |
| Z24874_PEA_2_T11 (SEQ ID NO: 19) | 615 | 955 |

Segment cluster Z24874_PEA_2_node_4 (SEQ ID NO:114) according to the present invention is supported by 19 libraries. The number of libraries was determined as previously described. This segment can be found in the following transcript(s): Z24874_PEA_2_T10 (SEQ ID NO:18) and Z24874_PEA_2_T11 (SEQ ID NO:19). Table 7 below describes the starting and ending position of this segment on each transcript.

TABLE 7

Segment location on transcripts

| Transcript name | Segment starting position | Segment ending position |
|---|---|---|
| Z24874_PEA_2_T10 (SEQ ID NO: 18) | 138 | 317 |
| Z24874_PEA_2_T11 (SEQ ID NO: 19) | 138 | 317 |

According to an optional embodiment of the present invention, short segments related to the above cluster are also provided. These segments are up to about 120 bp in length, and so are included in a separate description.

Segment cluster Z24874_PEA_2_node_0 (SEQ ID NO:115) according to the present invention is supported by 3 libraries. The number of libraries was determined as previously described. This segment can be found in the following transcript(s): Z24874_PEA_2_T10 (SEQ ID NO:18) and Z24874_PEA_2_T11 (SEQ ID NO:19). Table 8 below describes the starting and ending position of this segment on each transcript.

TABLE 8

Segment location on transcripts

| Transcript name | Segment starting position | Segment ending position |
|---|---|---|
| Z24874_PEA_2_T10 (SEQ ID NO: 18) | 1 | 77 |
| Z24874_PEA_2_T11 (SEQ ID NO: 19) | 1 | 77 |

Segment cluster Z24874_PEA_2_node_10 (SEQ ID NO:116) according to the present invention is supported by 25 libraries. The number of libraries was determined as previously described. This segment can be found in the following transcript(s): Z24874_PEA_2_T10 (SEQ ID NO:18) and Z24874_PEA_2_T11 (SEQ ID NO:19). Table 9 below describes the starting and ending position of this segment on each transcript.

TABLE 9

Segment location on transcripts

| Transcript name | Segment starting position | Segment ending position |
|---|---|---|
| Z24874_PEA_2_T10 (SEQ ID NO: 18) | 409 | 457 |
| Z24874_PEA_2_T11 (SEQ ID NO: 19) | 409 | 457 |

Segment cluster Z24874_PEA_2_node_12 (SEQ ID NO:117) according to the present invention is supported by 26 libraries. The number of libraries was determined as previously described. This segment can be found in the following transcript(s): Z24874_PEA_2_T10 (SEQ ID NO:18) and Z24874_PEA_2_T11 (SEQ ID NO:19). Table 10 below describes the starting and ending position of this segment on each transcript.

TABLE 10

Segment location on transcripts

| Transcript name | Segment starting position | Segment ending position |
|---|---|---|
| Z24874_PEA_2_T10 (SEQ ID NO: 18) | 458 | 524 |
| Z24874_PEA_2_T11 (SEQ ID NO: 19) | 458 | 524 |

Segment cluster Z24874_PEA_2_node_13 (SEQ ID NO:118) according to the present invention is supported by 21 libraries. The number of libraries was determined as previously described. This segment can be found in the following transcript(s): Z24874_PEA_2_T10 (SEQ ID NO:18) and Z24874_PEA_2_T11 (SEQ ID NO:19). Table 11 below describes the starting and ending position of this segment on each transcript.

TABLE 11

Segment location on transcripts

| Transcript name | Segment starting position | Segment ending position |
|---|---|---|
| Z24874_PEA_2_T10 (SEQ ID NO: 18) | 525 | 561 |
| Z24874_PEA_2_T11 (SEQ ID NO: 19) | 525 | 561 |

Segment cluster Z24874_PEA_2_node_14 (SEQ ID NO:119) according to the present invention is supported by 20 libraries. The number of libraries was determined as previously described. This segment can be found in the following transcript(s): Z24874_PEA_2_T10 (SEQ ID NO:18) and Z24874_PEA_2_T11 (SEQ ID NO:19). Table 12 below describes the starting and ending position of this segment on each transcript.

TABLE 12

Segment location on transcripts

| Transcript name | Segment starting position | Segment ending position |
|---|---|---|
| Z24874_PEA_2_T10 (SEQ ID NO: 18) | 562 | 614 |
| Z24874_PEA_2_T11 (SEQ ID NO: 19) | 562 | 614 |

Segment cluster Z24874_PEA_2_node_16 (SEQ ID NO:120) according to the present invention is supported by 17 libraries. The number of libraries was determined as previously described. This segment can be found in the following transcript(s): Z24874_PEA_2_T10 (SEQ ID NO:18). Table 13 below describes the starting and ending position of this segment on each transcript.

TABLE 13

Segment location on transcripts

| Transcript name | Segment starting position | Segment ending position |
|---|---|---|
| Z24874_PEA_2_T10 (SEQ ID NO: 18) | 615 | 686 |

Segment cluster Z24874_PEA_2_node_3 (SEQ ID NO:121) according to the present invention is supported by 8 libraries. The number of libraries was determined as previously described. This segment can be found in the following transcript(s): Z24874_PEA_2_T10 (SEQ ID NO:18) and Z24874_PEA_2_T11 (SEQ ID NO:19). Table 14 below describes the starting and ending position of this segment on each transcript.

TABLE 14

Segment location on transcripts

| Transcript name | Segment starting position | Segment ending position |
|---|---|---|
| Z24874_PEA_2_T10 (SEQ ID NO: 18) | 78 | 137 |
| Z24874_PEA_2_T11 (SEQ ID NO: 19) | 78 | 137 |

Segment cluster Z24874_PEA_2_node_6 (SEQ ID NO:122) according to the present invention is supported by 23 libraries. The number of libraries was determined as previously described. This segment can be found in the following transcript(s): Z24874_PEA_2_T10 (SEQ ID NO:18) and Z24874_PEA_2_T11 (SEQ ID NO:19). Table 15 below describes the starting and ending position of this segment on each transcript.

TABLE 15

Segment location on transcripts

| Transcript name | Segment starting position | Segment ending position |
|---|---|---|
| Z24874_PEA_2_T10 (SEQ ID NO: 18) | 318 | 408 |
| Z24874_PEA_2_T11 (SEQ ID NO: 19) | 318 | 408 |

Variant Protein Alignment to the Previously Known Protein:
Sequence name: /tmp/Ro5LG3OhE3/oQvcWauNWJ: Q9NPI5 (SEQ ID NO:372)

Sequence documentation:
Alignment of: Z24874_PEA_2_P5 (SEQ ID NO:297) xQ9NPI5 (SEQ ID NO:367)

Alignment segment 1/1:

| Quality: | 1307.00 | Escore: | 0 |
|---|---|---|---|
| Matching length: | 132 | Total length: | 132 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment

```
  1 MKLIVGIGGMTNGGKTTLTNSLLRALPNCCVIHQDDFFKPQDQIAVGEDG   50
    ||||||||||||||||||||||||||||||||||||||||||||||||||
  1 MKLIVGIGGMTNGGKTTLTNSLLRALPNCCVIHQDDFFKPQDQIAVGEDG   50

51 FKQWDVLESLDMEAMLDTVQAWLSSPQKFARAHGVSVQPEASDTHILLLE  100
    |||||||||||||||||||||||||||||||||||||||||||||||||
 51 FKQWDVLESLDMEAMLDTVQAWLSSPQKFARAHGVSVQPEASDTHILLLE  100

101 GFLLYSYKPLVDLYSRRYFLTVPYEECKWRRS                   132
    ||||||||||||||||||||||||||||||||
101 GFLLYSYKPLVDLYSRRYFLTVPYEECKWRRS                   132
```

Sequence name: /tmp/Ro5LG3OhE3/oQvcWauNWJ: Q9NZK3 (SEQ ID NO:373)

Sequence documentation:
Alignment of: Z24874_PEA_2_P5 (SEQ ID NO:297) xQ9NZK3 (SEQ ID NO:373)

Alignment segment 1/1:

| Quality: | 1070.00 | Escore: | 0 |
|---|---|---|---|
| Matching length: | 109 | Total length: | 109 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment

```
  1 MKLIVGIGGMTNGGKTTLTNSLLRALPNCCVIHQDDFFKPQDQIAVGEDG   50
    ||||||||||||||||||||||||||||||||||||||||||||||||||
  1 MKLIVGIGGMTNGGKTTLTNSLLRALPNCCVIHQDDFFKPQDQIAVGEDG   50

51 FKQWDVLESLDMEAMLDTVQAWLSSPQKFARAHGVSVQPEASDTHILLLE  100
    |||||||||||||||||||||||||||||||||||||||||||||||||
 51 FKQWDVLESLDMEAMLDTVQAWLSSPQKFARAHGVSVQPEASDTHILLLE  100
```

-continued

```
101  GFLLYSYKP                                                  109
     |||||||||
101  GFLLYSYKP                                                  109
```

Sequence name: /tmp/TxcClAWX3r/LIZBcJOujT:Q9NPI5 (SEQ ID NO:372)
Sequence documentation:
Alignment of: Z24874_PEA_2_P6 (SEQ ID NO:298) xQ9NPI5 (SEQ ID NO:372)

| Alignment segment 1/1: | | | |
|---|---|---|---|
| Quality: | 1048.00 | Escore: | 0 |
| Matching length: | 107 | Total length: | 107 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment

```
  1  MKLIVGIGGMTNGGKTTLTNSLLRALPNCCVIHQDDFFKPQDQIAVGEDG           50
     ||||||||||||||||||||||||||||||||||||||||||||||||||
  1  MKLIVGIGGMTNGGKTTLTNSLLRALPNCCVIHQDDFFKPQDQIAVGEDG           50

51  FKQWDVLESLDMEAMLDTVQAWLSSPQKFARAHGVSVQPEASDTHILLLE          100
     ||||||||||||||||||||||||||||||||||||||||||||||||||
 51  FKQWDVLESLDMEAMLDTVQAWLSSPQKFARAHGVSVQPEASDTHILLLE          100

101  GFLLYSY                                                    107
     |||||||
101  GFLLYSY                                                    107
```

Sequence name: /tmp/TxcClAWX3r/LIZBcJOujT:Q9NZK3 (SEQ ID NO:373)
Sequence documentation:
Alignment of: Z24874_PEA_2_P6 (SEQ ID NO:298) xQ9NZK3 (SEQ ID NO:373)

| Alignment segment 1/1: | | | |
|---|---|---|---|
| Quality: | 1048.00 | Escore: | 0 |
| Matching length: | 107 | Total length: | 107 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment

```
  1  MKLIVGIGGMTNGGKTTLTNSLLRALPNCCVIHQDDFFKPQDQIAVGEDG           50
     ||||||||||||||||||||||||||||||||||||||||||||||||||
  1  MKLIVGIGGMTNGGKTTLTNSLLRALPNCCVIHQDDFFKPQDQIAVGEDG           50

51  FKQWDVLESLDMEAMLDTVQAWLSSPQKFARAHGVSVQPEASDTHILLLE          100
     ||||||||||||||||||||||||||||||||||||||||||||||||||
 51  FKQWDVLESLDMEAMLDTVQAWLSSPQKFARAHGVSVQPEASDTHILLLE          100

101  GFLLYSY                                                    107
     |||||||
101  GFLLYSY                                                    107
```

Description for Cluster HUMCDDANF

Cluster HUMCDDANF features 2 transcript(s) and 7 segment(s) of interest, the names for which are given in Tables 1 and 2, respectively, the sequences themselves are given at the end of the application. The selected protein variants are given in table 3.

TABLE 1

| Transcripts of interest | |
|---|---|
| Transcript Name | Seq ID No. |
| HUMCDDANF_T3 | 20 |
| HUMCDDANF_T4 | 21 |

TABLE 2

| Segments of interest | |
|---|---|
| Segment Name | Seq ID No. |
| HUMCDDANF_node_0 | 123 |
| HUMCDDANF_node_10 | 124 |
| HUMCDDANF_node_2 | 125 |
| HUMCDDANF_node_5 | 126 |
| HUMCDDANF_node_8 | 127 |
| HUMCDDANF_node_11 | 128 |
| HUMCDDANF_node_12 | 129 |

TABLE 3

Proteins of interest

| Protein Name | Seq ID No. |
|---|---|
| HUMCDDANF_P2 | 299 |
| HUMCDDANF_P3 | 300 |

These sequences are variants of the known protein Atrial natriuretic factor precursor (SEQ ID NO:350) (SwissProt accession identifier ANF_HUMAN; known also according to the synonyms ANF; Atrial natriuretic peptide; ANP; Prepronatriodilatin), referred to herein as the previously known protein; it contains Cardiodilatin-related peptide (CDP).

Protein Atrial natriuretic factor precursor (SEQ ID NO:350) is known or believed to have the following function(s): Atrial natriuretic factor (ANF) is a potent vasoactive substance synthesized in mammalian atria and is thought to play a key role in cardiovascular homeostasis; has a cGMP-stimulating activity. The sequence for protein Atrial natriuretic factor precursor is given at the end of the application, as "Atrial natriuretic factor precursor amino acid sequence" (SEQ ID NO:350). Known polymorphisms for this sequence are as shown in Table 4.

TABLE 4

Amino acid mutations for Known Protein

| SNP position(s) on amino acid sequence | Comment |
|---|---|
| 32 | V -> M (in dbSNP:5063). /FTId=VAR_014579. |
| 152-153 | Missing (in isoform 2). /FTId=VAR_000594. |
| 65 | E -> D |

Protein Atrial natriuretic factor precursor (SEQ ID NO:350) localization is believed to be Secreted.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Aldosterone antagonist; Diuretic; Electrolyte absorption agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Antihypertensive, diuretic; Antiasthma; Urological; Cardiostimulant, Antianaemic, Cardiovascular, Neuroprotective, Fertility enhancer, Male contraceptive, Hypolipaemic/Antiatherosclerosis, Hepatoprotective and renal failure.

The following GO Annotation(s) apply to the previously known protein. The following annotation(s) were found: physiological processes; blood pressure regulation, which are annotation(s) related to Biological Process; hormone activity, which are annotation(s) related to Molecular Function; and extracellular, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink>.

The heart-selective diagnostic marker prediction engine provided the following results with regard to cluster HUM-CDDANF. Predictions were made for selective expression of transcripts of this cluster in heart tissue, according to the previously described methods. The numbers on the y-axis of FIG. 17A refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 17A, concerning the number of heart-specific clones in libraries/sequences; as well as with regard to the histogram in FIG. 17B, concerning the actual expression of oligonucleotides in various tissues, including heart.

This cluster was found to be selectively expressed in heart for the following reasons: a comparison of the ratio of expression of the cluster in heart specific ESTs to the overall expression of the cluster in non-heart ESTs was found to be 56.3; The expression levels of this gene in muscle was negligible; and fisher exact test P-values were computed both for library and weighted clone counts to check that the counts are statistically significant, and were found to be 1.20 E-249.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the expression levels of this gene in muscle was negligible, which clearly supports specific expression in heart tissue.

As noted above, cluster HUMCDDANF features 2 transcript(s), which were listed in Table 1 above. These transcript(s) encode for protein(s) which are variant(s) of protein Atrial natriuretic factor precursor (SEQ ID NO:350). A description of each variant protein according to the present invention is now provided.

Variant protein HUMCDDANF_P2 (SEQ ID NO:299) according to the present invention has an amino acid sequence as given at the end of the application; it is encoded by transcript(s) HUMCDDANF_T3 (SEQ ID NO:20). An alignment is given to the known protein (Atrial natriuretic factor precursor (SEQ ID NO:350)) at the end of the application. One or more alignments to one or more previously published protein sequences are given at the end of the application. A brief description of the relationship of the variant protein according to the present invention to each such aligned protein is as follows:

Comparison report between HUMCDDANF_P2 (SEQ ID NO:299) and ANF_HUMAN (SEQ ID NO:350):

1. An isolated chimeric polypeptide encoding for HUMCDDANF_P2 (SEQ ID NO:299), comprising a first amino acid sequence being at least 90% homologous to MPLEDEVVPPQVLSEPNEEAGAALSPLPEVPP-WTGEVSPAQRDGGALGRGPWDSSDRS ALLKSKL-RALLTAPRSLRRSSCFGGRMDRIGAQSGLGCNSFRY corresponding to amino acids 51-151 of ANF_HUMAN (SEQ ID NO:350), which also corresponds to amino acids 1-101 of HUMCDDANF_P2 (SEQ ID NO:299).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein HUMCDDANF_P2 (SEQ ID NO:299) also has the following non-silent SNPs (Single Nucleotide Polymorphisms) as listed in Table 7, (given according to their position(s) on the amino acid sequence, with the alternative amino acid(s) listed; the last column indicates whether the SNP is known or not; the presence of known SNPs in variant protein HUMCDDANF_P2 (SEQ ID NO:299) sequence provides support for the deduced sequence of this variant protein according to the present invention).

TABLE 7

Amino acid mutations

| SNP position(s) on amino acid sequence | Alternative amino acid(s) | Previously known SNP? |
| --- | --- | --- |
| 20 | A -> V | Yes |
| 27 | L -> F | Yes |
| 74 | S -> | No |
| 76 | R -> Q | Yes |

Variant protein HUMCDDANF_P2 (SEQ ID NO:299) is encoded by the following transcript(s): HUMCDDANF_T3 (SEQ ID NO:20), for which the sequence(s) is/are given at the end of the application. The coding portion of transcript HUMCDDANF_T3 (SEQ ID NO:20) is shown in bold; this coding portion starts at position 381 and ends at position 683. The transcript also has the following SNPs as listed in Table 8 (given according to their position on the nucleotide sequence, with the alternative nucleic acid listed; the last column indicates whether the SNP is known or not; the presence of known SNPs in variant protein HUMCDDANF_P2 (SEQ ID NO:299) sequence provides support for the deduced sequence of this variant protein according to the present invention).

TABLE 8

Nucleic acid SNPs

| SNP position on nucleotide sequence | Alternative nucleic acid | Previously known SNP? |
| --- | --- | --- |
| 199 | C -> T | Yes |
| 374 | A -> G | No |
| 771 | T -> C | Yes |
| 778 | T -> C | Yes |
| 809 | C -> T | Yes |
| 887 | C -> G | No |
| 968 | A -> C | Yes |
| 439 | C -> T | Yes |
| 458 | C -> T | No |
| 459 | C -> T | Yes |
| 602 | C -> | No |
| 607 | G -> A | Yes |
| 684 | T -> C | Yes (short/long variant) |
| 711 | A -> G | No |
| 757 | G -> T | Yes |

Variant protein HUMCDDANF_P3 (SEQ ID NO:300) according to the present invention has an amino acid sequence as given at the end of the application; it is encoded by transcript(s) HUMCDDANF_T4 (SEQ ID NO:21). An alignment is given to the known protein (Atrial natriuretic factor precursor (SEQ ID NO:350)) at the end of the application. One or more alignments to one or more previously published protein sequences are given at the end of the application. A brief description of the relationship of the variant protein according to the present invention to each such aligned protein is as follows:

Comparison report between HUMCDDANF_P3 (SEQ ID NO:300) and ANF_HUMAN (SEQ ID NO:350):

1. An isolated chimeric polypeptide encoding for HUMCDDANF_P3 (SEQ ID NO:300), comprising a first amino acid sequence being at least 70%, optionally at least 80%, preferably at least 85%, more preferably at least 90% and most preferably at least 95% homologous to a polypeptide having the sequence MSSFSTTT (SEQ ID NO:411) corresponding to amino acids 1-8 of HUMCDDANF_P3 (SEQ ID NO:300), and a second amino acid sequence being at least 90% homologous to NLLDHLEEKMPLEDEVVP-PQVLSEPNEEAGAALSPLPEVPPWTGEV-SPAQRDGGALGR GPWDSSDRSALLKSKLRALLTAP-RSLRRSSCFGGRMDRIGAQSGLGCNSFRY corresponding to amino acids 42-151 of ANF_HUMAN (SEQ ID NO:350), which also corresponds to amino acids 9-118 of HUMCDDANF_P3 (SEQ ID NO:300), wherein said first and second amino acid sequences are contiguous and in a sequential order.

2. An isolated polypeptide encoding for a head of HUMCDDANF_P3 (SEQ ID NO:300), comprising a polypeptide being at least 70%, optionally at least about 80%, preferably at least about 85%, more preferably at least about 90% and most preferably at least about 95% homologous to the sequence MSSFSTTT (SEQ ID NO:411) of HUMCDDANF_P3 (SEQ ID NO:300)

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HUMCDDANF_P3 (SEQ ID NO:300) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein HUMCDDANF_P3 (SEQ ID NO:300) sequence provides support for the deduced sequence of this variant protein according to the present invention).

TABLE 9

Amino acid mutations

| SNP position(s) on amino acid sequence | Alternative amino acid(s) | Previously known SNP? |
| --- | --- | --- |
| 37 | A -> V | Yes |
| 44 | L -> F | Yes |

TABLE 9-continued

Amino acid mutations

| SNP position(s) on amino acid sequence | Alternative amino acid(s) | Previously known SNP? |
|---|---|---|
| 91 | S -> | No |
| 93 | R -> Q | Yes |

Variant protein HUMCDDANF_P3 (SEQ ID NO:300) is encoded by the following transcript(s): HUMCDDANF_T4 (SEQ ID NO:21), for which the sequence(s) is/are given at the end of the application. The coding portion of transcript HUMCDDANF_T4 (SEQ ID NO:21) is shown in bold; this coding portion starts at position 104 and ends at position 457. The transcript also has the following SNPs as listed in Table 10 (given according to their position on the nucleotide sequence, with the alternative nucleic acid listed; the last column indicates whether the SNP is known or not; the presence of known SNPs in variant protein HUMCDDANF_P3 (SEQ ID NO:300) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 148 | A -> G | No |
| 213 | C -> T | Yes |
| 552 | T -> C | Yes |
| 583 | C -> T | Yes |
| 661 | C -> G | No |
| 742 | A -> C | Yes |
| 232 | C -> T | No |
| 233 | C -> T | Yes |
| 376 | C -> | No |
| 381 | G -> A | Yes |
| 458 | T -> C | Yes (short/long isoform) |
| 485 | A -> G | No |
| 531 | G -> T | Yes |
| 545 | T -> C | Yes |

As noted above, cluster HUMCDDANF features 7 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMCDDANF_node_0 (SEQ ID NO:123) according to the present invention is supported by 5 libraries. The number of libraries was determined as previously described. This segment can be found in the following transcript(s): HUMCDDANF_T3 (SEQ ID NO:20). Table 11 below describes the starting and ending position of this segment on each transcript.

TABLE 11

Segment location on transcripts

| Transcript name | Segment starting position | Segment ending position |
|---|---|---|
| HUMCDDANF_T3 (SEQ ID NO: 20) | 1 | 353 |

Segment cluster HUMCDDANF_node_10 (SEQ ID NO:124) according to the present invention is supported by 49 libraries. The number of libraries was determined as previously described. This segment can be found in the following transcript(s): HUMCDDANF_T3 (SEQ ID NO:20) and HUMCDDANF_T4 (SEQ ID NO:21). Table 12 below describes the starting and ending position of this segment on each transcript.

TABLE 12

Segment location on transcripts

| Transcript name | Segment starting position | Segment ending position |
|---|---|---|
| HUMCDDANF_T3 (SEQ ID NO: 20) | 813 | 940 |
| HUMCDDANF_T4 (SEQ ID NO: 21) | 587 | 714 |

Segment cluster HUMCDDANF_node_2 (SEQ ID NO:125) according to the present invention is supported by 41 libraries. The number of libraries was determined as previously described. This segment can be found in the following transcript(s): HUMCDDANF_T4 (SEQ ID NO:21). Table 13 below describes the starting and ending position of this segment on each transcript.

TABLE 13

Segment location on transcripts

| Transcript name | Segment starting position | Segment ending position |
|---|---|---|
| HUMCDDANF_T4 (SEQ ID NO: 21) | 1 | 127 |

Segment cluster HUMCDDANF_node_5 (SEQ ID NO:126) according to the present invention is supported by 62 libraries. The number of libraries was determined as previously described. This segment can be found in the following transcript(s): HUMCDDANF_T3 (SEQ ID NO:20) and HUMCDDANF_T4 (SEQ ID NO:21). Table 14 below describes the starting and ending position of this segment on each transcript.

TABLE 14

Segment location on transcripts

| Transcript name | Segment starting position | Segment ending position |
|---|---|---|
| HUMCDDANF_T3 (SEQ ID NO: 20) | 354 | 680 |
| HUMCDDANF_T4 (SEQ ID NO: 21) | 128 | 454 |

Segment cluster HUMCDDANF_node_8 (SEQ ID NO:127) according to the present invention is supported by 56 libraries. The number of libraries was determined as previously described. This segment can be found in the following transcript(s): HUMCDDANF_T3 (SEQ ID NO:20) and HUMCDDANF_T4 (SEQ ID NO:21). Table 15 below describes the starting and ending position of this segment on each transcript.

TABLE 15

Segment location on transcripts

| Transcript name | Segment starting position | Segment ending position |
|---|---|---|
| HUMCDDANF_T3 (SEQ ID NO: 20) | 681 | 812 |
| HUMCDDANF_T4 (SEQ ID NO: 21) | 455 | 586 |

According to an optional embodiment of the present invention, short segments related to the above cluster are also provided. These segments are up to about 120 bp in length, and so are included in a separate description.

Segment cluster HUMCDDANF_node_11 (SEQ ID NO:128) according to the present invention can be found in the following transcript(s): HUMCDDANF_T3 (SEQ ID NO:20) and HUMCDDANF_T4 (SEQ ID NO:21). Table 16 below describes the starting and ending position of this segment on each transcript.

TABLE 16

Segment location on transcripts

| Transcript name | Segment starting position | Segment ending position |
|---|---|---|
| HUMCDDANF_T3 (SEQ ID NO: 20) | 941 | 951 |
| HUMCDDANF_T4 (SEQ ID NO: 21) | 715 | 725 |

Segment cluster HUMCDDANF_node_12 (SEQ ID NO:129) according to the present invention is supported by 36 libraries. The number of libraries was determined as previously described. This segment can be found in the following transcript(s): HUMCDDANF_T3 (SEQ ID NO:20) and HUMCDDANF_T4 (SEQ ID NO:21). Table 17 below describes the starting and ending position of this segment on each transcript.

TABLE 17

Segment location on transcripts

| Transcript name | Segment starting position | Segment ending position |
|---|---|---|
| HUMCDDANF_T3 (SEQ IDNO: 20) | 952 | 992 |
| HUMCDDANF_T4 (SEQ IDNO: 21) | 726 | 766 |

Variant protein alignment to the previously known protein:

Sequence name: /tmp/3GyiZQyJ8L/jYng3zFfcE:ANF_HUMAN (SEQ ID NO:350)

Sequence documentation:

Alignment of: HUMCDDANF_P2 (SEQ ID NO:299) ×ANF_HUMAN (SEQ ID NO:350)

| Alignment segment 1/1: | | | |
|---|---|---|---|
| Quality: | 988.00 | Escore: | 0 |
| Matching length: | 101 | Total length: | 101 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment

```
  1 MPLEDEVVPPQVLSEPNEEAGAALSPLPEVPPWTGEVSPAQRDGGALGRG    50
    ||||||||||||||||||||||||||||||||||||||||||||||||||
 51 MPLEDEVVPPQVLSEPNEEAGAALSPLPEVPPWTGEVSPAQRDGGALGRG   100

51 PWDSSDRSALLKSKLRALLTAPRSLRRSSCFGGRMDRIGAQSGLGCNSFR   100
    |||||||||||||||||||||||||||||||||||||||||||||||||
101 PWDSSDRSALLKSKLRALLTAPRSLRRSSCFGGRMDRIGAQSGLGCNSFR   150

101 Y                                                   101
    |
151 Y                                                   151
```

Sequence name: /tmp/mnb7OPVCPP/oTrSwgJLyB:ANF_HUMAN (SEQ ID NO:350)

Sequence documentation:

Alignment of: HUMCDDANF_P3 (SEQ ID NO:300) ×ANF_HUMAN (SEQ ID NO:350)

| Alignment segment 1/1: | | | |
|---|---|---|---|
| Quality: | 1076.00 | Escore: | 0 |
| Matching length: | 110 | Total length: | 110 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment

```
  9 NLLDHLEEKMPLEDEVVPPQVLSEPNEEAGAALSPLPEVPPWTGEVSPAQ   58
    ||||||||||||||||||||||||||||||||||||||||||||||||||
 42 NLLDHLEEKMPLEDEVVPPQVLSEPNEEAGAALSPLPEVPPWTGEVSPAQ   91

59 RDGGALGRGPWDSSDRSALLKSKLRALLTAPRSLRRSSCFGGRMDRIGAQ  108
    ||||||||||||||||||||||||||||||||||||||||||||||||||
 92 RDGGALGRGPWDSSDRSALLKSKLRALLTAPRSLRRSSCFGGRMDRIGAQ  141

109 SGLGCNSFRY                                          118
    ||||||||||
142 SGLGCNSFRY                                          151
```

Expression of Human Cardiodilatin-Atrial Natriuretic Factor (CDD-ANF) HUMCDDANF Transcripts which are Detectable by Amplicon as Depicted in Sequence Name HUHUMCDDANFjunc2-5F2R2 (SEQ ID NO:376) Specifically in Heart Tissue Expression of Human cardiodilatin-atrial natriuretic factor (CDD-ANF) transcripts detectable by or according to junc2-5 node(s), HUHUMCDDANFjunc2-5F2R2 (SEQ ID NO:376) amplicon and primers HUMCDDANFjunc2-5F2 (SEQ ID NO:374) HUMCDDANFjunc2-5R2 (SEQ ID NO:375) was measured by real time PCR (this transcript relates to the known or WT protein). In parallel the expression of four housekeeping genes—RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)), Ubiquitin (GenBank Accession No. BC000449 (SEQ ID NO:445); amplicon—Ubiquitin-amplicon (SEQ ID NO:448)) and SDHA (GenBank Accession No. NM_004168 (SEQ ID NO:449); amplicon—SDHA-amplicon (SEQ ID NO:452)) was measured similarly. For each RT sample, the expression of the above amplicons was normalized to the geometric mean of the quantities of the housekeeping genes. The normalized quantity of each RT sample was then divided by the quantity of heart sample no. 45 (Table 1, above), to obtain a value of relative expression for each sample relative to this heart sample.

Figure 18:
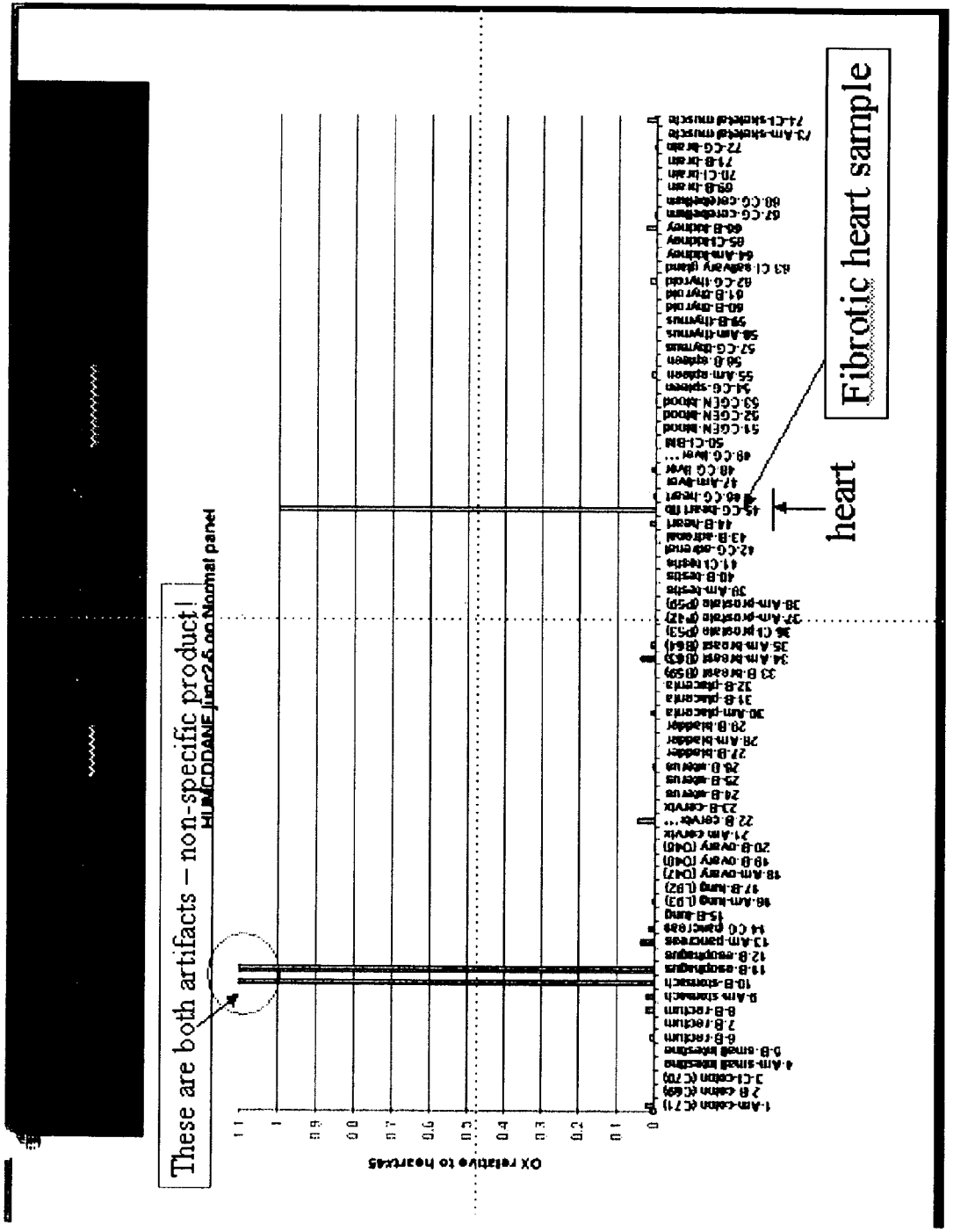
FIG. 18 is a histogram showing expression of known protein transcript for HUMCDDANF_T4 (SEQ ID NO:21).

As is evident from FIG. 18, the expression of Human cardiodilatin-atrial natriuretic factor (CDD-ANF) transcripts detectable by the above amplicon(s) in one of the heart tissue samples (Sample Nos. 45, Table 1, "Tissue samples in testing panel") was significantly higher than in the other samples, including other two heart samples. Sample 45 is from fibrotic heart, as opposed to heart samples 44 and 46 that are from normal hearts. (Note—the product in samples 10 and 11 was found to be a non-specific product by inspecting the dissociation curve that was created in the real-time PCR experiment).

Primer pairs are also optionally and preferably encompassed within the present invention; for example, for the above experiment, the following primer pair was used as a non-limiting illustrative example only of a suitable primer pair: HUMCDDANFjunc2-5F2 (SEQ ID NO:374) forward primer; and HUMCDDANFjunc2-5R2 (SEQ ID NO:375) reverse primer.

The present invention also preferably encompasses any amplicon obtained through the use of any suitable primer pair; for example, for the above experiment, the following amplicon was obtained as a non-limiting illustrative example only of a suitable amplicon: HUHUMCDDANFjunc2-5F2R2 (SEQ ID NO:376).

Forward primer HUMCDDANFjunc2-5F2 (SEQ ID NO:374):
CTTCTCCACCACCACCAATTTG

Reverse primer HUMCDDANFjunc2-5R2 (SEQ ID NO:375):
GAGAGCAGCCCCCGCT

Amplicon HUMCDDANFjunc2-5F2R2 (SEQ ID NO:376):
CTTCTCCACCACCACCAATTTGCTGGACCATTTGGAAGAAAAGATGCCTT
TAGAAGATGAGGTCGTGCCCCCACAAGTGCTCAGTGAGCCGAATGAAGAA
GCGGGGCTGCTCTC Description for Cluster HUMTROPIA Cluster HUMTROPIA features 4 transcript(s) and 20 segment(s) of interest, the names for which are given in Tables 1 and 2, respectively, the sequences themselves are given at the end of the application. The selected protein variants are given in table 3.

TABLE 1

Transcripts of interest

| Transcript Name | Seq ID No. |
|---|---|
| HUMTROPIA_PEA_2_T10 | 22 |
| HUMTROPIA_PEA_2_T15 | 23 |
| HUMTROPIA_PEA_2_T3 | 24 |
| HUMTROPIA_PEA_2_T7 | 25 |

TABLE 2

Segments of interest

| Segment Name | Seq ID No. |
|---|---|
| HUMTROPIA_PEA_2_node_0 | 130 |
| HUMTROPIA_PEA_2_node_10 | 131 |
| HUMTROPIA_PEA_2_node_22 | 132 |
| HUMTROPIA_PEA_2_node_23 | 133 |
| HUMTROPIA_PEA_2_node_11 | 134 |
| HUMTROPIA_PEA_2_node_14 | 135 |
| HUMTROPIA_PEA_2_node_15 | 136 |
| HUMTROPIA_PEA_2_node_16 | 137 |
| HUMTROPIA_PEA_2_node_20 | 138 |
| HUMTROPIA_PEA_2_node_21 | 139 |
| HUMTROPIA_PEA_2_node_24 | 140 |
| HUMTROPIA_PEA_2_node_25 | 141 |
| HUMTROPIA_PEA_2_node_29 | 142 |
| HUMTROPIA_PEA_2_node_30 | 143 |
| HUMTROPIA_PEA_2_node_31 | 144 |
| HUMTROPIA_PEA_2_node_32 | 145 |
| HUMTROPIA_PEA_2_node_4 | 146 |

TABLE 2-continued

Segments of interest

| Segment Name | Seq ID No. |
|---|---|
| HUMTROPIA_PEA_2_node_5 | 147 |
| HUMTROPIA_PEA_2_node_8 | 148 |
| HUMTROPIA_PEA_2_node_9 | 149 |

TABLE 3

Proteins of interest

| Protein Name | Seq ID No. |
|---|---|
| HUMTROPIA_PEA_2_P5 | 301 |
| HUMTROPIA_PEA_2_P12 | 302 |
| HUMTROPIA_PEA_2_P17 | 303 |
| HUMTROPIA_PEA_2_P18 | 304 |

These sequences are variants of the known protein Troponin I, cardiac muscle (SwissProt accession identifier TRIC_HUMAN), referred to herein as the previously known protein and shown as SEQ ID NO: 351.

Protein Troponin I, cardiac muscle (SEQ ID NO:351) is known or believed to have the following function(s): Troponin I is the inhibitory subunit of troponin, the thin filament regulatory complex which confers calcium-sensitivity to striated muscle actomyosin ATPase activity. Troponin I, cardiac muscle (SEQ ID NO:351) Binds to actin and tropomyosin. Defects in Troponin I, cardiac muscle (SEQ ID NO:351) are the cause of familial hypertrophic cardiomyopathy type 7 (CMH7) [MIM:191044]; also known as FHC type 7. CMH7 is an autosomal dominant disorder characterized by increased myocardial mass with myocyte and myofibrillar disarray. Defects in Troponin I, cardiac muscle (SEQ ID NO:351) are the cause of familial restrictive cardiomyopathy (RCM) [MIM:115210]. RCM is a heart muscle disorder characterized by impaired filling of the ventricles with reduced volume in the presence of normal or near normal wall thickness and systolic function. The disease may be associated with systemic disease but is most often idiopathic. The sequence for protein Troponin I, cardiac muscle is given at the end of the application, as "Troponin I, cardiac muscle amino acid sequence" (SEQ ID NO:351). Known polymorphisms for this sequence are as shown in Table 4.

TABLE 4

Amino acid mutations for Known Protein

| SNP position(s) on amino acid sequence | Comment |
|---|---|
| 81 | P -> S (in CMH7). /FTId=VAR_016078. |
| 143 | L -> Q (in RCM). /FTId=VAR_016079. |
| 144 | R -> G (in CMH7). /FTId=VAR_007603. |
| 144 | R -> W (in RCM). /FTId=VAR_016080. |
| 170 | A -> T (in RCM). /FTId=VAR_016081. |
| 177 | K -> E (in RCM). /FTId=VAR_016082. |
| 189 | D -> H (in CMH7 and RCM). /FTId = VAR_016083. |
| 191 | R -> H (in RCM). /FTId=VAR_016084. |
| 195 | D -> N (in CMH7). /FTId=VAR_016085. |
| 205 | K -> Q (in CMH7). /FTId=VAR_007604. |

In addition to the above known polymorphisms, the present inventors have uncovered two new additional SNPs (shown with regard to SEQ ID NO:352 for the resultant amino acid sequence, and SEQ ID NO:353 for the nucleic acid sequence). This SNP is C->(missing nucleotide "C"; will affect amino acid residues from 167 onwards). This will create a frame shift. A new protein will be formed. However, this SNP was located in a stretch of cytosine residues, which are known to be prone to errors in sequencing.

The previously known protein also has the following indication(s) and/or potential therapeutic use(s): Cancer, lung, non-small cell; Cancer, breast; Cancer, sarcoma. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Angiogenesis inhibitor; Epidermal growth factor antagonist; Fibroblast growth factor receptor antagonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Ophthalmological; Anticancer.

The following GO Annotation(s) apply to the previously known protein. The following annotation(s) were found: control of heart, which are annotation(s) related to Biological Process; and troponin complex, which are annotation(s) related to Cellular Component.

The GO assignment relies on information from one or more of the SwissProt/TremB1Protein knowledgebase, available from <dot expasy dot ch/sprot/>; or Locuslink, available from <dot ncbi dot nlm dot nih dot gov/projects/LocusLink/>.

The heart-selective diagnostic marker prediction engine provided the following results with regard to cluster HUMTROPIA. Predictions were made for selective expression of transcripts of this cluster in heart tissue, according to the previously described methods. The numbers on the y-axis of FIG. 19 refer to weighted expression of ESTs in each category, as "parts per million" (ratio of the expression of ESTs for a particular cluster to the expression of all ESTs in that category, according to parts per million).

Overall, the following results were obtained as shown with regard to the histogram in FIG. 19, concerning the number of heart-specific clones in libraries/sequences; as well as with regard to the histogram in FIG. 20, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 27.5. The expression level of this gene in muscle was negligible; and fisher exact test P-values were computed both for library and weighted clone counts to check that the counts are statistically significant, and were found to be 2.10E-88.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the expression level of this gene in muscle was negligible which clearly supports specific expression in heart tissue.

As noted above, cluster HUMTROPIA features 4 transcript(s), which were listed in Table 1 above. These transcript(s) encode for protein(s) which are variant(s) of protein Troponin I, cardiac muscle (SEQ ID NO:351). A description of each variant protein according to the present invention is now provided.

Variant protein HUMTROPIA_PEA_2_P5 (SEQ ID NO:301) according to the present invention has an amino acid sequence as given at the end of the application; it is encoded by transcript(s) HUMTROPIA_PEA_2_T3 (SEQ ID NO:24). An alignment is given to the known protein (Troponin I, cardiac muscle (SEQ ID NO:351)) at the end of the application. One or more alignments to one or more previously published protein sequences are given at the end of the application. A brief description of the relationship of the variant protein according to the present invention to each such aligned protein is as follows:

Comparison report between HUMTROPIA_PEA_2_P5 (SEQ ID NO:301) and TRIC_HUMAN (SEQ ID NO:351):

1. An isolated chimeric polypeptide encoding for HUMTROPIA_PEA_2_P5 (SEQ ID NO:301), comprising a first amino acid sequence being at least 90% homologous to MADGSSDAAREPRPAPAPIRRRSS-NYRAYATEPHAKKKSKISASRKLQLKTLLLQIAKQ ELEREAEERRGEKGRALSTRCQPLELA-GLGFAELQDLCRQLHARVDKVDEERYDIEAK VTKNITE corresponding to amino acids 1-124 of TRI-C_HUMAN (SEQ ID NO:351), which also corresponds to amino acids 1-124 of HUMTROPIA_PEA_2_P5 (SEQ ID NO:301), and a second amino acid sequence being at least 70%, optionally at least 80%, preferably at least 85%, more preferably at least 90% and most preferably at least 95% homologous to a polypeptide having the sequence VGRMGSSGTFGVG (SEQ ID NO:412) corresponding to amino acids 125-137 of HUMTROPIA_PEA_2_P5 (SEQ ID NO:301), wherein said first and second amino acid sequences are contiguous and in a sequential order.

2. An isolated polypeptide encoding for a tail of HUMTROPIA_PEA_2_P5 (SEQ ID NO:301), comprising a polypeptide being at least 70%, optionally at least about 80%, preferably at least about 85%, more preferably at least about 90% and most preferably at least about 95% homologous to the sequence VGRMGSSGTFGVG (SEQ ID NO:412) in HUMTROPIA_PEA_2_P5 (SEQ ID NO:301).

The cellular location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein HUMTROPIA_PEA_2_P5 (SEQ ID NO:301) is encoded by the following transcript(s): HUMTROPIA_PEA_2_T3 (SEQ ID NO:24), for which the sequence(s) is/are given at the end of the application. The coding portion of transcript HUMTROPIA_PEA_2_T3 (SEQ ID NO:24) is shown in bold; this coding portion starts at position 148 and ends at position 558.

Variant protein HUMTROPIA_PEA_2_P12 (SEQ ID NO:302) according to the present invention has an amino acid sequence as given at the end of the application; it is encoded by transcript(s) HUMTROPIA_PEA_2_T15 (SEQ ID NO:23). An alignment is given to the known protein (Troponin I, cardiac muscle (SEQ ID NO:351)) at the end of the application. One or more alignments to one or more previously published protein sequences are given at the end of the application. A brief description of the relationship of the variant protein according to the present invention to each such aligned protein is as follows:

Comparison report between HUMTROPIA_PEA_2_P12 (SEQ ID NO:302) and TRIC_HUMAN (SEQ ID NO:351):

1. An isolated chimeric polypeptide encoding for HUMTROPIA_PEA_2_P12 (SEQ ID NO:302), comprising a first amino acid sequence being at least 90% homologous to MADGSSDA corresponding to amino acids 1-8 of TRIC_HUMAN (SEQ ID NO:351), which also corresponds to amino acids 1-8 of HUMTROPIA_PEA_2_P12 (SEQ ID NO:302), and a second amino acid sequence being at least 70%, optionally at least 80%, preferably at least 85%, more preferably at least 90% and most preferably at least 95% homologous to a polypeptide having the sequence KKSKISASRKLQLKTLLLQIAKQELERE-AEERRGEKGRALSTRCQPLELAGL GFAELQDL-CRQLHARVDKVDEERYDIEAKVTKNITE-IADLTQKIFDLRGKFKRPTLRRV RISADAMMQALLGARAKESLDLRAHL-KQVKKEDTEKENREVGDWRKNIDALSGMEG RKKKFES corresponding to amino acids 36-209 of TRI-C_HUMAN (SEQ ID NO:351), which also corresponding to amino acids 9-182 of HUMTROPIA_PEA_2_P12 (SEQ ID NO:302), wherein said first and second amino acid sequences are contiguous and in a sequential order.

2. An isolated chimeric polypeptide encoding for an edge portion of HUMTROPIA_PEA_2_P12 (SEQ ID NO:302), comprising a polypeptide having a length "n", wherein "n" is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AK, having a structure as follows: a sequence starting from any of amino acid numbers 8−x to 8; and ending at any of amino acid numbers 9+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein HUMTROPIA_PEA_2_P12 (SEQ ID NO:302) is encoded by the following transcript(s): HUMTROPIA_PEA_2_T 15 (SEQ ID NO:23), for which the sequence(s) is/are given at the end of the application. The coding portion of transcript HUMTROPIA_PEA_2_T115 (SEQ ID NO:23) is shown in bold; this coding portion starts at position 148 and ends at position 693.

Variant protein HUMTROPIA_PEA_2_P17 (SEQ ID NO:303) according to the present invention has an amino acid sequence as given at the end of the application; it is encoded by transcript(s) HUMTROPIA_PEA_2_T7 (SEQ ID NO:25). An alignment is given to the known protein (Troponin I, cardiac muscle (SEQ ID NO:351)) at the end of the application. One or more alignments to one or more previously published protein sequences are given at the end of the application. A brief description of the relationship of the variant protein according to the present invention to each such aligned protein is as follows:

Comparison report between HUMTROPIA_PEA_2_P17 (SEQ ID NO:303) and TRIC_HUMAN (SEQ ID NO:351):

1. An isolated chimeric polypeptide encoding for HUMTROPIA_PEA_2_P17 (SEQ ID NO:303), comprising a first amino acid sequence being at least 90% homologous to MADGSSDAAREPRPAPAPIRRRSS-NYRAYATEPHAK corresponding to amino acids 1-36 of TRIC_HUMAN (SEQ ID NO:351), which also corresponds to amino acids 1-36 of HUMTROPIA_PEA_2_P17 (SEQ ID NO:303), and a second amino acid sequence being at least 70%, optionally at least 80%, preferably at least 85%, more preferably at least 90% and most preferably at least 95% homologous to a polypeptide having the sequence VGRGFLGAEYRRRRDPRPWEWGEEPGLR-RGRGLRGGASGAEFCRGSCSDW (SEQ ID NO:413) corresponding to amino acids 37-86 of HUMTROPIA_PEA_2_P17 (SEQ ID NO:303), wherein said first and second amino acid sequences are contiguous and in a sequential order.

2. An isolated polypeptide encoding for a tail of HUMTROPIA_PEA_2_P17 (SEQ ID NO:303), comprising a polypeptide being at least 70%, optionally at least about 80%, preferably at least about 85%, more preferably at least about 90% and most preferably at least about 95% homologous to the sequence VGRGFLGAEYRRRRDPRP-WEWGEEPGLRRGRGLRGGASGAEFCRGSCSDW (SEQ ID NO:413) in HUMTROPIA_PEA_2_P17 (SEQ ID NO:303).

The location of the variant protein was determined according to results from a number of different software programs and analyses, including analyses from SignalP and other specialized programs. The variant protein is believed to be located as follows with regard to the cell: intracellularly. The protein localization is believed to be intracellular because neither of the trans-membrane region prediction programs predicted a trans-membrane region for this protein. In addition both signal-peptide prediction programs predict that this protein is a non-secreted protein.

Variant protein HUMTROPIA_PEA_2_P17 (SEQ ID NO:303) is encoded by the following transcript(s): HUMTROPIA_PEA_2_T7 (SEQ ID NO:25), for which the sequence(s) is/are given at the end of the application. The coding portion of transcript HUMTROPIA_PEA_2_T7 (SEQ ID NO:25) is shown in bold; this coding portion starts at position 148 and ends at position 405.

Variant protein HUMTROPIA_PEA_2_P18 (SEQ ID NO:304) according to the present invention has an amino acid sequence as given at the end of the application; it is encoded by transcript(s) HUMTROPIA_PEA_2_T10 (SEQ ID NO:22). An alignment is given to the known protein (Troponin I, cardiac muscle (SEQ ID NO:351)) at the end of the application. One or more alignments to one or more previously published protein sequences are given at the end of the application. A brief description of the relationship of the variant protein according to the present invention to each such aligned protein is as follows:

Comparison report between HUMTROPIA_PEA_2_P18 (SEQ ID NO:304) and TRIC_HUMAN (SEQ ID NO:351):

1. An isolated chimeric polypeptide encoding for HUMTROPIA_PEA_2_P18 (SEQ ID NO:304), comprising a first amino acid sequence being at least 90% homologous to MADGSSDA corresponding to amino acids 1-8 of TRIC_HUMAN (SEQ ID NO:351), which also corresponds to amino acids 1-8 of HUMTROPIA_PEA_2_P18 (SEQ ID NO:304), and a second amino acid sequence being at least 70%, optionally at least 80%, preferably at least 85%, more preferably at least 90% and most preferably at least 95% homologous to a polypeptide having the sequence VRAAG (SEQ ID NO:414) corresponding to amino acids 9-13 of HUMTROPIA_PEA_2_P118 (SEQ ID NO:304), wherein said first and second amino acid sequences are contiguous and in a sequential order.

2. An isolated polypeptide encoding for a tail of HUMTROPIA_PEA_2_P18 (SEQ ID NO:304), comprising a polypeptide being at least 70%, optionally at least about 80%, preferably at least about 85%, more preferably at least about 90% and most preferably at least about 95% homologous to the sequence VRAAG (SEQ ID NO:414) in HUMTROPIA_PEA_2_P18 (SEQ ID NO:304).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HUMTROPIA_PEA_2_P18 (SEQ ID NO:304) is encoded by the following transcript(s): HUMTROPIA_PEA_2_T10 (SEQ ID NO:22), for which the sequence(s) is/are given at the end of the application. The coding portion of transcript HUMTROPIA_PEA_2_T10 (SEQ ID NO:22) is shown in bold; this coding portion starts at position 148 and ends at position 186.

As noted above, cluster HUMTROPIA features 20 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMTROPIA_PEA_2_node_0 (SEQ ID NO:130) according to the present invention is supported by 29 libraries. The number of libraries was determined as previously described. This segment can be found in the following transcript(s): HUMTROPIA_PEA_2_T10 (SEQ ID NO:22), HUMTROPIA_PEA_2_T15 (SEQ ID NO:23), HUMTROPIA_PEA_2_T3 (SEQ ID NO:24) and HUMTROPIA_PEA_2_T7 (SEQ ID NO:25), Table 7 below describes the starting and ending position of this segment on each transcript.

TABLE 7

Segment location on transcripts

| Transcript name | Segment starting position | Segment ending position |
|---|---|---|
| HUMTROPIA_PEA_2_T10 (SEQ ID NO: 22) | 1 | 158 |
| HUMTROPIA_PEA_2_T15 (SEQ ID NO: 23) | 1 | 158 |
| HUMTROPIA_PEA_2_T3 (SEQ ID NO: 24) | 1 | 158 |
| HUMTROPIA_PEA_2_T7 (SEQ ID NO: 25) | 1 | 158 |

Segment cluster HUMTROPIA_PEA_2_node_10 (SEQ ID NO:131) according to the present invention is supported by 5 libraries. The number of libraries was determined as previously described. This segment can be found in the following transcript(s): HUMTROPIA_PEA_2_T7 (SEQ ID NO:25). Table 8 below describes the starting and ending position of this segment on each transcript.

TABLE 8

Segment location on transcripts

| Transcript name | Segment starting position | Segment ending position |
|---|---|---|
| HUMTROPIA_PEA_2_T7 (SEQ ID NO: 25) | 256 | 660 |

Segment cluster HUMTROPIA_PEA_2_node_22 (SEQ ID NO:132) according to the present invention is supported by 8 libraries. The number of libraries was determined as previously described. This segment can be found in the following transcript(s): HUMTROPIA_PEA_2_T3 (SEQ ID NO:24). Table 9 below describes the starting and ending position of this segment on each transcript.

TABLE 9

Segment location on transcripts

| Transcript name | Segment starting position | Segment ending position |
|---|---|---|
| HUMTROPIA_PEA_2_T3 (SEQ ID NO: 24) | 520 | 1053 |

Segment cluster HUMTROPIA_PEA_2_node_23 (SEQ ID NO:133) according to the present invention is supported by 49 libraries. The number of libraries was determined as previously described. This segment can be found in the following transcript(s): HUMTROPIA_PEA_2_T10 (SEQ ID NO:22), HUMTROPIA_PEA_2_T15 (SEQ ID NO:23), HUMTROPIA_PEA_2_T3 (SEQ ID NO:24) and HUMTROPIA_PEA_2_T7 (SEQ ID NO:25), Table 10 below describes the starting and ending position of this segment on each transcript.

TABLE 10

Segment location on transcripts

| Transcript name | Segment starting position | Segment ending position |
|---|---|---|
| HUMTROPIA_PEA_2_T10 (SEQ ID NO: 22) | 565 | 708 |
| HUMTROPIA_PEA_2_T15 (SEQ ID NO: 23) | 436 | 579 |
| HUMTROPIA_PEA_2_T3 (SEQ ID NO: 24) | 1054 | 1197 |
| HUMTROPIA_PEA_2_T7 (SEQ ID NO: 25) | 925 | 1068 |

According to an optional embodiment of the present invention, short segments related to the above cluster are also provided. These segments are up to about 120 bp in length, and so are included in a separate description.

Segment cluster HUMTROPIA_PEA_2_node_11 (SEQ ID NO:134) according to the present invention is supported by 28 libraries. The number of libraries was determined as previously described. This segment can be found in the following transcript(s): HUMTROPIA_PEA_2_T10 (SEQ ID NO:22), HUMTROPIA_PEA_2_T15 (SEQ ID NO:23), HUMTROPIA_PEA_2_T3 (SEQ ID NO:24) and HUMTROPIA_PEA_2_T7 (SEQ ID NO:25). Table 11 below describes the starting and ending position of this segment on each transcript.

TABLE 11

Segment location on transcripts

| Transcript name | Segment starting position | Segment ending position |
|---|---|---|
| HUMTROPIA_PEA_2_T10 (SEQ ID NO: 22) | 301 | 342 |
| HUMTROPIA_PEA_2_T15 (SEQ ID NO: 23) | 172 | 213 |
| HUMTROPIA_PEA_2_T3 (SEQ ID NO: 24) | 256 | 297 |
| HUMTROPIA_PEA_2_T7 (SEQ ID NO: 25) | 661 | 702 |

Segment cluster HUMTROPIA_PEA_2_node_14 (SEQ ID NO:135) according to the present invention is supported by 37 libraries. The number of libraries was determined as previously described. This segment can be found in the following transcript(s): HUMTROPIA_PEA_2_T10 (SEQ ID NO:22), HUMTROPIA_PEA_2_T15 (SEQ ID NO:23), HUMTROPIA_PEA_2_T3 (SEQ ID NO:24) and HUMTROPIA_PEA_2_T7 (SEQ ID NO:25). Table 12 below describes the starting and ending position of this segment on each transcript.

TABLE 12

Segment location on transcripts

| Transcript name | Segment starting position | Segment ending position |
|---|---|---|
| HUMTROPIA_PEA_2_T10 (SEQ ID NO: 22) | 343 | 378 |
| HUMTROPIA_PEA_2_T15 (SEQ ID NO: 23) | 214 | 249 |
| HUMTROPIA_PEA_2_T3 (SEQ ID NO: 24) | 298 | 333 |
| HUMTROPIA_PEA_2_T7 (SEQ ID NO: 25) | 703 | 738 |

Segment cluster HUMTROPIA_PEA_2_node_15 (SEQ ID NO:136) according to the present invention is supported by 42 libraries. The number of libraries was determined as previously described. This segment can be found in the following transcript(s): HUMTROPIA_PEA_2_T10 (SEQ ID NO:22), HUMTROPIA_PEA_2_T15 (SEQ ID No:23), HUMTROPIA_PEA_2$_{13}$ T3 (SEQ ID NO:24) and HUMTROPIA_PEA_2_T7 (SEQ ID NO:25). Table 13 below describes the starting and ending position of this segment on each transcript.

TABLE 13

Segment location on transcripts

| Transcript name | Segment starting position | Segment ending position |
|---|---|---|
| HUMTROPIA_PEA_2_T10 (SEQ ID NO: 22) | 379 | 422 |
| HUMTROPIA_PEA_2_T15 (SEQ ID NO: 23) | 250 | 293 |
| HUMTROPIA_PEA_2_T3 (SEQ ID NO: 24) | 334 | 377 |
| HUMTROPIA_PEA_2_T7 (SEQ ID NO: 25) | 739 | 782 |

Segment cluster HUMTROPIA_PEA_2_node_16 (SEQ ID NO:137) according to the present invention is supported by 40 libraries. The number of libraries was determined as previously described. This segment can be found in the following transcript(s): HUMTROPIA_PEA_2_T10 (SEQ ID NO:22), HUMTROPIA_PEA_2_T15 (SEQ ID NO:23), HUMTROPIA_PEA_2_T3 (SEQ ID NO:24) and HUMTROPIA_PEA_2_T7 (SEQ ID NO:25). Table 14 below describes the starting and ending position of this segment on each transcript.

TABLE 14

Segment location on transcripts

| Transcript name | Segment starting position | Segment ending position |
| --- | --- | --- |
| HUMTROPIA_PEA_2_T10 (SEQ ID NO: 22) | 423 | 474 |
| HUMTROPIA_PEA_2_T15 (SEQ ID NO: 23) | 294 | 345 |
| HUMTROPIA_PEA_2_T3 (SEQ ID NO: 24) | 378 | 429 |
| HUMTROPIA_PEA_2_T7 (SEQ ID NO: 25) | 783 | 834 |

Segment cluster HUMTROPIA_PEA_2_node_20 (SEQ ID NO:138) according to the present invention is supported by 44 libraries. The number of libraries was determined as previously described. This segment can be found in the following transcript(s): HUMTROPIA_PEA_2_T10 (SEQ ID NO:22), HUMTROPIA_PEA_2_T15 (SEQ ID NO:23), HUMTROPIA_PEA_2_T3 (SEQ ID NO:24) and HUMTROPIA_PEA_2_T7 (SEQ ID NO:25). Table 15 below describes the starting and ending position of this segment on each transcript.

TABLE 15

Segment location on transcripts

| Transcript name | Segment starting position | Segment ending position |
| --- | --- | --- |
| HUMTROPIA_PEA_2_T10 (SEQ ID NO: 22) | 475 | 510 |
| HUMTROPIA_PEA_2_T15 (SEQ ID NO: 23) | 346 | 381 |
| HUMTROPIA_PEA_2_T3 (SEQ ID NO: 24) | 430 | 465 |
| HUMTROPIA_PEA_2_T7 (SEQ ID NO: 25) | 835 | 870 |

Segment cluster HUMTROPIA_PEA_2_node_21 (SEQ ID NO:139) according to the present invention is supported by 44 libraries. The number of libraries was determined as previously described. This segment can be found in the following transcript(s): HUMTROPIA_PEA_2_T10 (SEQ ID NO:22), HUMTROPIA_PEA_2_13_T15 (SEQ ID NO:23), HUMTROPIA_PEA_2_T3 (SEQ ID NO:24) and HUMTROPIA_PEA_2_T7 (SEQ ID NO:25). Table 16 below describes the starting and ending position of this segment on each transcript.

TABLE 16

Segment location on transcripts

| Transcript name | Segment starting position | Segment ending position |
| --- | --- | --- |
| HUMTROPIA_PEA_2_T10 (SEQ ID NO: 22) | 511 | 564 |
| HUMTROPIA_PEA_2_T15 (SEQ ID NO: 23) | 382 | 435 |
| HUMTROPIA_PEA_2_T3 (SEQ ID NO: 24) | 466 | 519 |
| HUMTROPIA_PEA_2_T7 (SEQ ID NO: 25) | 871 | 924 |

Segment cluster HUMTROPIA_PEA_2_node_24 (SEQ ID NO:140) according to the present invention can be found in the following transcript(s): HUMTROPIA_PEA_2_T10 (SEQ ID NO:22), HUMTROPIA_PEA_2_T5 (SEQ ID NO:23), HUMTROPIA_PEA_2_T10(SEQ NO:24) and HUMTROPIA_PEA_2_T7 (SEQ ID NO:25). Table 17 below describes the starting and ending position of this segment on each transcript.

TABLE 17

Segment location on transcripts

| Transcript name | Segment starting position | Segment ending position |
| --- | --- | --- |
| HUMTROPIA_PEA_2_T10 (SEQ ID NO: 22) | 709 | 726 |
| HUMTROPIA_PEA_2_T15 (SEQ ID NO: 23) | 580 | 597 |
| HUMTROPIA_PEA_2_T3 (SEQ ID NO: 24) | 1198 | 1215 |
| HUMTROPIA_PEA_2_T7 (SEQ ID NO: 25) | 1069 | 1086 |

Segment cluster HUMTROPIA_PEA_2_node_25 (SEQ ID NO:141) according to the present invention can be found in the following transcript(s): HUMTROPIA_PEA_2_T10 (SEQ ID NO:22), HUMTROPIA_PEA_2_T15 (SEQ ID NO:23), HUMTROPIA_PEA_2_T10(SEQ ID NO:24) and HUMTROPIA_PEA_2_T7 (SEQ ID NO:25). Table 18 below describes the starting and ending position of this segment on each transcript.

TABLE 18

Segment location on transcripts

| Transcript name | Segment starting position | Segment ending position |
| --- | --- | --- |
| HUMTROPIA_PEA_2_T10 (SEQ ID NO: 22) | 727 | 741 |
| HUMTROPIA_PEA_2_T15 (SEQ ID NO: 23) | 598 | 612 |
| HUMTROPIA_PEA_2_T3 (SEQ ID NO: 24) | 1216 | 1230 |
| HUMTROPIA_PEA_2_T7 (SEQ ID NO: 25) | 1087 | 1101 |

Segment cluster HUMTROPIA_PEA_2_node_29 (SEQ ID NO:142) according to the present invention can be found in the following transcript(s): HUMTROPIA_PEA_2_T10 (SEQ ID NO:22), HUMTROPIA_PEA_2_T15 (SEQ ID NO:23), HUMTROPIA_PEA_2_T3(SEQ ID NO:24) and HUMTROPIA_PEA_2_T7 (SEQ ID NO:25). Table 19 below describes the starting and ending position of this segment on each transcript.

TABLE 19

Segment location on transcripts

| Transcript name | Segment starting position | Segment ending position |
| --- | --- | --- |
| HUMTROPIA_PEA_2_T10 (SEQ ID NO: 22) | 742 | 761 |
| HUMTROPIA_PEA_2_T15 (SEQ ID NO: 23) | 613 | 632 |
| HUMTROPIA_PEA_2_T3 (SEQ ID NO: 24) | 1231 | 1250 |
| HUMTROPIA_PEA_2_T7 (SEQ ID NO: 25) | 1102 | 1121 |

Segment cluster HUMTROPIA_PEA_2_node_30 (SEQ ID NO:143) according to the present invention can be found in the following transcript(s): HUMTROPIA_PEA_2_T10 (SEQ ID NO:22), HUMTROPIA_PEA_2_T15 (SEQ ID NO:23), HUMTROPIA_PEA_2_T10(SEQ ID NO:24) and HUMTROPIA_PEA_2_T7 (SEQ ID NO:25). Table 20 below describes the starting and ending position of this segment on each transcript.

TABLE 20

Segment location on transcripts

| Transcript name | Segment starting position | Segment ending position |
| --- | --- | --- |
| HUMTROPIA_PEA_2_T10 (SEQ ID NO: 22) | 762 | 774 |
| HUMTROPIA_PEA_2_T15 (SEQ ID NO: 23) | 633 | 645 |
| HUMTROPIA_PEA_2_T3 (SEQ ID NO: 24) | 1251 | 1263 |
| HUMTROPIA_PEA_2_T7 (SEQ ID NO: 25) | 1122 | 1134 |

Segment cluster HUMTROPIA_PEA_2_node_31 (SEQ ID NO:144) according to the present invention can be found in the following transcript(s): HUMTROPIA_PEA_2_T10 (SEQ ID NO:22), HUMTROPIA_PEA_2_T15 (SEQ ID NO:23), HUMTROPIA_PEA_2_T3(SEQ ID NO:24) and HUMTROPIA_PEA_2_T7 (SEQ ID NO:25). Table 21 below describes the starting and ending position of this segment on each transcript.

TABLE 21

Segment location on transcripts

| Transcript name | Segment starting position | Segment ending position |
| --- | --- | --- |
| HUMTROPIA_PEA_2_T10 (SEQ ID NO: 22) | 775 | 798 |
| HUMTROPIA_PEA_2_T15 (SEQ ID NO: 23) | 646 | 669 |
| HUMTROPIA_PEA_2_T3 (SEQ ID NO: 24) | 1264 | 1287 |
| HUMTROPIA_PEA_2_T7 (SEQ ID NO: 25) | 1135 | 1158 |

Segment cluster HUMTROPIA_PEA_2_node_32 (SEQ ID NO:145) according to the present invention is supported by 40 libraries. The number of libraries was determined as previously described. This segment can be found in the following transcript(s): HUMTROPIA_PEA_2_T10 (SEQ ID NO:22), HUMTROPIA_PEA_2_T15 (SEQ ID NO:23), HUMTROPIA_PEA_2$_{13}$ T3 (SEQ ID NO:24) and HUMTROPIA_PEA_2_T7 (SEQ ID NO:25). Table 22 below describes the starting and ending position of this segment on each transcript.

TABLE 22

Segment location on transcripts

| Transcript name | Segment starting position | Segment ending position |
| --- | --- | --- |
| HUMTROPIA_PEA_2_T10 (SEQ ID NO: 22) | 799 | 892 |
| HUMTROPIA_PEA_2_T15 (SEQ ID NO: 23) | 670 | 763 |
| HUMTROPIA_PEA_2_T3 (SEQ ID NO: 24) | 1288 | 1381 |
| HUMTROPIA_PEA_2_T7 (SEQ ID NO: 25) | 1159 | 1252 |

Segment cluster HUMTROPIA_PEA_2_node_4 (SEQ ID NO:146) according to the present invention can be found in the following transcript(s): HUMTROPIA_PEA_2_T10 (SEQ ID NO:22), HUMTROPIA_PEA_2_T15 (SEQ ID NO:23), HUMTROPIA_PEA_2_T3(SEQ ID NO:24) and HUMTROPIA_PEA_2_T7 (SEQ ID NO:25). Table 23 below describes the starting and ending position of this segment on each transcript.

TABLE 23

Segment location on transcripts

| Transcript name | Segment starting position | Segment ending position |
| --- | --- | --- |
| HUMTROPIA_PEA_2_T10 (SEQ ID NO: 22) | 159 | 171 |
| HUMTROPIA_PEA_2_T15 (SEQ ID NO: 23) | 159 | 171 |
| HUMTROPIA_PEA_2_T3 (SEQ ID NO: 24) | 159 | 171 |
| HUMTROPIA_PEA_2_T7 (SEQ ID NO: 25) | 159 | 171 |

Segment cluster HUMTROPIA_PEA_2_node_5 (SEQ ID NO:147) according to the present invention is supported by 6 libraries. The number of libraries was determined as previously described. This segment can be found in the following transcript(s): HUMTROPIA_PEA_2_T10 (SEQ ID NO:22). Table 24 below describes the starting and ending position of this segment on each transcript.

TABLE 24

Segment location on transcripts

| Transcript name | Segment starting position | Segment ending position |
| --- | --- | --- |
| HUMTROPIA_PEA_2_T10 (SEQ ID NO: 22) | 172 | 216 |

Segment cluster HUMTROPIA_PEA_2_node_8 (SEQ ID NO:148) according to the present invention is supported by 27 libraries. The number of libraries was determined as previously described. This segment can be found in the following transcript(s): HUMTROPIA_PEA_2_T10 (SEQ ID NO:22), HUMTROPIA_PEA_2_T3 (SEQ ID NO:24)

and HUMTROPIA_PEA_2_T7 (SEQ ID NO:25). Table 25 below describes the starting and ending position of this segment on each transcript.

TABLE 25

Segment location on transcripts

| Transcript name | Segment starting position | Segment ending position |
|---|---|---|
| HUMTROPIA_PEA_2_T10 (SEQ ID NO: 22) | 217 | 266 |
| HUMTROPIA_PEA_2_T3 (SEQ ID NO: 24) | 172 | 221 |
| HUMTROPIA_PEA_2_T7 (SEQ ID NO: 25) | 172 | 221 |

Segment cluster HUMTROPIA_PEA_2_node$_{13}$ 9 (SEQ ID NO:149) according to the present invention is supported by 27 libraries. The number of libraries was determined as previously described. This segment can be found in the following transcript(s): HUMTROPIA_PEA_2_T10 (SEQ ID NO:22), HUMTROPIA_PEA_2_T3 (SEQ ID NO:24) and HUMTROPIA_PEA_2_T7 (SEQ ID NO:25). Table 26 below describes the starting and ending position of this segment on each transcript.

TABLE 26

Segment location on transcripts

| Transcript name | Segment starting position | Segment ending position |
|---|---|---|
| HUMTROPIA_PEA_2_T10 (SEQ ID NO: 22) | 267 | 300 |
| HUMTROPIA_PEA_2_T3 (SEQ ID NO: 24) | 222 | 255 |
| HUMTROPIA_PEA_2_T7 (SEQ ID NO: 25) | 222 | 255 |

Variant Protein Alignment to the Previously Known Protein:

Sequence name: /tmp/p5CHmauP3/NVyK804uFt:TRIC$_{HUMAN}$ (SEQ ID NO:351)

Sequence documentation:

Alignment of: HUMTROPIA_$_{PEA}$_2_P5 (SEQ ID NO:301) xTRIC_HUMAN (SEQ ID NO:351)

Alignment segment 1/1:

| | | | |
|---|---|---|---|
| Quality: | 1183.00 | Escore: | 0 |
| Matching length: | 124 | Total length: | 124 |
| Matching Percent Similarity: | 100.00 | Matching Percent Identity: | 99.19 |
| Total Percent Similarity: | 100.00 | Total Percent Identity: | 99.19 |
| Gaps: | 0 | | |

Alignment:

```
  2  ADGSSDAAREPRPAPAPIRRRSSNYRAYATEPHAKKKSKISASRKLQLKT   51
     ||||||||||||||||||||||||||||||||||||||||||||||||||
  1  ADGSSDAAREPRPAPAPIRRRSSNYRAYATEPHAKKKSKISASRKLQLKT   50

52  LLLQIAKQELEREAEERRGEKGRALSTRCQPLELAGLGFAELQDLCRQLH  101
     |||||||||||||||||||||||||||||||||||||||||||||||||
 51  LLLQIAKQELEREAEERRGEKGRALSTRCQPLELAGLGFAELQDLCRQLH  100

102  ARVDKVDEERYDIEAKVTKNITEV                            125
     |||||||||||||||||||||||:
101  ARVDKVDEERYDIEAKVTKNITEI                            124
```

Sequence name: /tmp/gCDnOSmn31/GzfEmz5N5Z:TRIC_$_{HUMAN}$ (SEQ ID NO:351)

Sequence documentation:

Alignment of: HUMTROPIA_$_{PEA}$_2_P12 (SEQ ID NO:302) xTRIC_HUMAN (SEQ ID NO:351)

Alignment segment 1/1:
Alignment:

| | | | |
|---|---|---|---|
| Quality: | 873.00 | Length: | 209 |
| Ratio: | 4.823 | Gaps: | 1 |
| Percent Similarity: | 86.603 | Percent Identity: | 86.603 | alignment_block:

HUMTROPIA_PEA_2_P12 (SEQ ID NO:302) xTroponin

Align seg 1/1 to: Troponin from: 1 to: 209

```
  2 ADGSSDA......................KKSKISASRKLQLKT        23
    |||||||                      ||||||||||||||||
  1 ADGSSDAAREPRPAPAPIRRRSSNYRAYATEPHAKKKSKISASRKLQLKT   50

24 LLLQIAKQELEREAEERRGEKGRALSTRCQPLELAGLGFAELQDLCRQLH   73
    ||||||||||||||||||||||||||||||||||||||||||||||||||
 51 LLLQIAKQELEREAEERRGEKGRALSTRCQPLELAGLGFAELQDLCRQLH  100

74 ARVDKVDEERYDIEAKVTKNITEIADLTQKIFDLRGKFKRPTLRRVRISA  123
    ||||||||||||||||||||||||||||||||||||||||||||||||||
101 ARVDKVDEERYDIEAKVTKNITEIADLTQKIFDLRGKFKRPTLRRVRISA  150

124 DAMMQALLGARAKESLDLRAHLKQVKKEDTEKENREVGDWRKNIDALSGM  173
    ||||||||||||||||||||||||||||||||||||||||||||||||||
151 DAMMQALLGARAKESLDLRAHLKQVKKEDTEKENREVGDWRKNIDALSGM  200

174 EGRKKKFES  182
    |||||||||
201 EGRKKKFES  209
```

Sequence name: /tmp/o8saIrMOll/UU1NosjzB3:TRIC$_{HUMAN}$ (SEQ ID NO:351)

Sequence documentation:

Alignment of: HUMTROPIA$_{\_PEA\_}$2_P17 (SEQ ID NO:303) ×TRIC_HUMAN (SEQ ID NO:351)

| Alignment segment 1/1: | | | |
|---|---|---|---|
| Quality: | 344.00 | Escore: | 0 |
| Matching length: | 35 | Total length: | 35 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment

```
  2 ADGSSDAAREPRPAPAPIRRRSSNYRAYATEPHAK   36
    ||||||||||||||||||||||||||||||||||
  1 ADGSSDAAREPRPAPAPIRRRSSNYRAYATEPHAK   35
```

Sequence name: /tmp/shMGxspSCh/hLCzvaP2j:TRIC$_{HUMAN}$ (SEQ ID NO:351)

Sequence documentation:

Alignment of: HUMTROPIA$_{\_PEA\_}$2_P18 (SEQ ID NO:304) ×TRIC_HUMAN (SEQ ID NO:351)

| Alignment segment 1/1: | | | |
|---|---|---|---|
| Quality: | 71.00 | Escore: | 0 |
| Matching length: | 9 | Total length: | 9 |
| Matching Percent Similarity: | 88.89 | Matching Percent Identity: | 88.89 |
| Total Percent Similarity: | 88.89 | Total Percent Identity: | 88.89 |
| Gaps: | 0 | | |

```
2  ADGSSDAVR
   ||||||| |
1  ADGSSDAAR
```

10

9

Expression of TRIC_HUMAN Troponin I, Cardiac Muscle HUMTROPIA Transcripts which are Detectable by Amplicon as Depicted in Sequence Name HUMTROPIA seg10 Specifically in Heart Tissue Expression of TRIC_HUMAN Troponin I, cardiac muscle transcripts detectable by or according to seg10 node(s), HUMTROPIA seg10 amplicon(s) (SEQ ID NO:379) and HUMTROPIA seg10F2 (SEQ ID NO:377) and HUMTROPIA seg10R2 (SEQ ID NO:378) primers was measured by real time PCR. In parallel the expression of four housekeeping genes—Ubiquitin (GenBank Accession No. BC000449 (SEQ ID NO:445); amplicon—Ubiquitin-amplicon (SEQ ID NO:448)) and SDHA (GenBank Accession No. NM_004168 (SEQ ID NO:449); amplicon—SDHA-amplicon (SEQ ID NO:452)), RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)) was measured similarly. For each RT sample, the expression of the above amplicons was normalized to the geometric mean of the quantities of the housekeeping genes. The normalized quantity of each RT sample was then divided by the median of the quantities of the heart samples (Sample Nos. 44-46, Table 1, above "Tissue samples in testing panel"), to obtain a value of fold up-regulation for each sample relative to median of the heart.

Figure 21A:
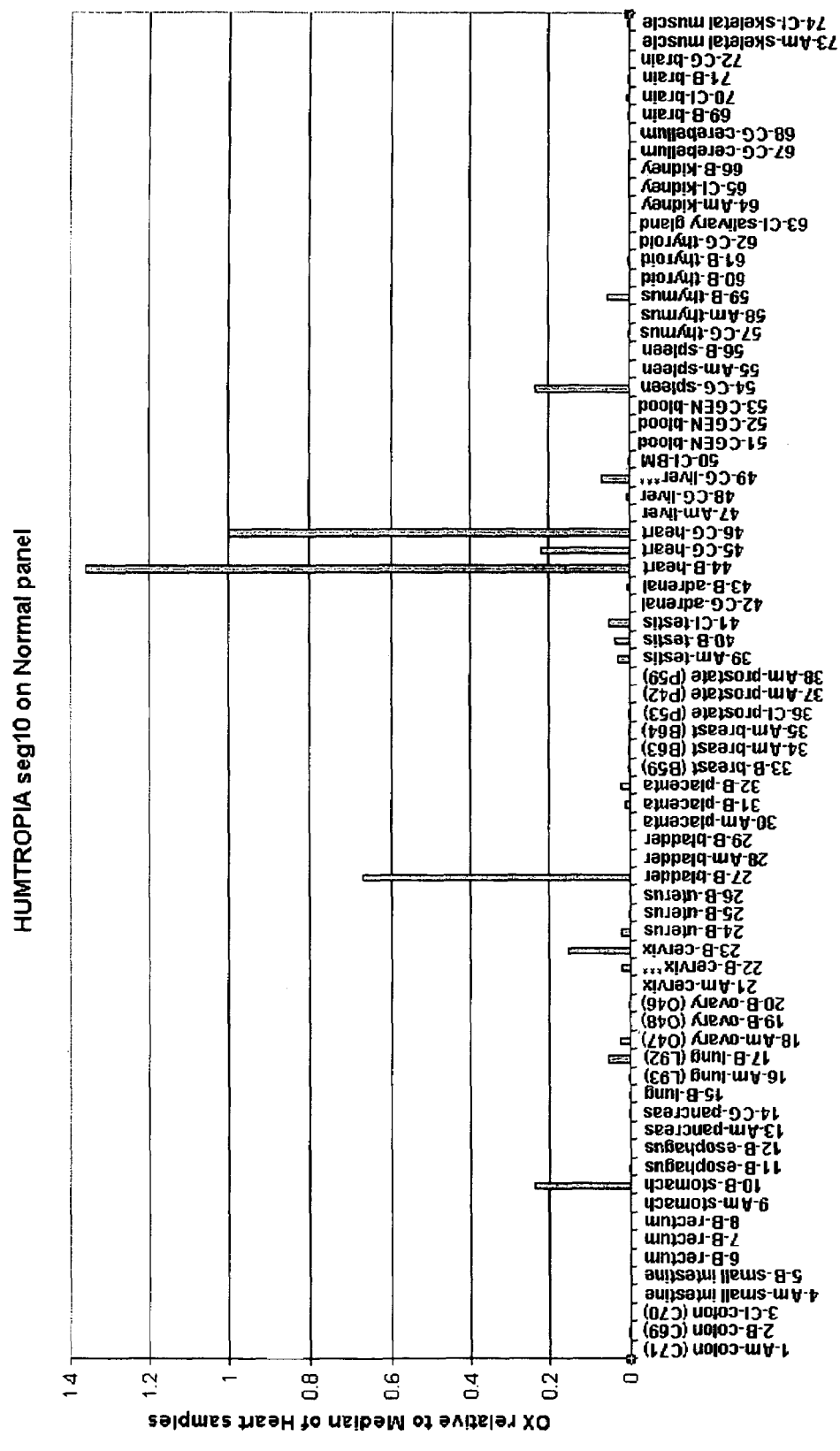
FIG. 21A is a histogram showing specific expression of the above-indicated TRIC_HUMAN Troponin I, cardiac muscle HUMTROPIA transcripts in sequence HUMTROPIA seg10 in heart tissue (SEQ ID NO:379).

FIG. 21A is a histogram showing specific expression of the above-indicated TRIC_HUMAN Troponin I, cardiac muscle transcripts in heart tissue samples as opposed to other tissues.

As is evident from FIG. 21A, the expression of TRIC_HUMAN Troponin I, cardiac muscle transcripts detectable by the above amplicon(s) in heart tissue samples was significantly higher than in most other samples (non-heart tissue sample Nos. 1-9, 11-26, 28-43, 47-74 Table 1 above "Tissue samples in testing panel").

Primer pairs are also optionally and preferably encompassed within the present invention; for example, for the above experiment, the following primer pair was used as a non-limiting illustrative example only of a suitable primer pair: HUMTROPIA seg10F2 forward primer (SEQ ID NO:377); and HUMTROPIA seg10R2 reverse primer (SEQ ID NO:378).

The present invention also preferably encompasses any amplicon obtained through the use of any suitable primer pair; for example, for the above experiment, the following amplicon was obtained as a non-limiting illustrative example only of a suitable amplicon: HUMTROPIA seg10 (SEQ ID NO:379).

HUMTROPIA seg1 Forward primer (SEQ ID NO:377):
TTGCAGAGGGTCATGCTCG

HUMTROPIA seg1 Reverse primer (SEQ ID NO:378):
TCCTTTGGATAGGCACTTCCC

-continued

HUMTROPIA seg1 Amplicon (SEQ ID NO:379):
TTGCAGAGGGTCATGCTCGGATTGGTGACAGCAGCCTGCGGGCGGAACT
CCGTTGCCCTCGGACTTGCTTAGGGATAGATGGGAAGTGCCTATCCAAA
GGA

Expression TRIC_HUMAN Troponin I, Cardiac Muscle HUMTROPIA Transcripts, which are Detectable by Amplicon as Depicted in Sequence Name HUMTROPIA seg22 Specifically in Heart Tissue Expression of TRIC_HUMAN Troponin I, cardiac muscle transcripts detectable by or according to seg22 node(s), HUMTROPIA seg22 amplicon(s) (SEQ ID NO:382) and HUMTROPIA seg22F (SEQ ID NO:380) and HUMTROPIA seg22R (SEQ ID NO:381) primers was measured by real time PCR. In parallel the expression of four housekeeping genes—RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)), Ubiquitin (GenBank Accession No. BC000449 (SEQ ID NO:445); amplicon—Ubiquitin-amplicon (SEQ ID NO:448)) and SDHA (GenBank Accession No. NM_004168 (SEQ ID NO:449); amplicon—SDHA-amplicon (SEQ ID NO:452)), was measured similarly. For each RT sample, the expression of the above amplicons was normalized to the geometric mean of the quantities of the housekeeping genes. The normalized quantity of each RT sample was then divided by the median of the quantities of the heart samples (Sample Nos. 44-46, Table 1, above, "Tissue samples in testing panel"), to obtain a value of fold up-regulation for each sample relative to median of the heart.

Figure 21B:
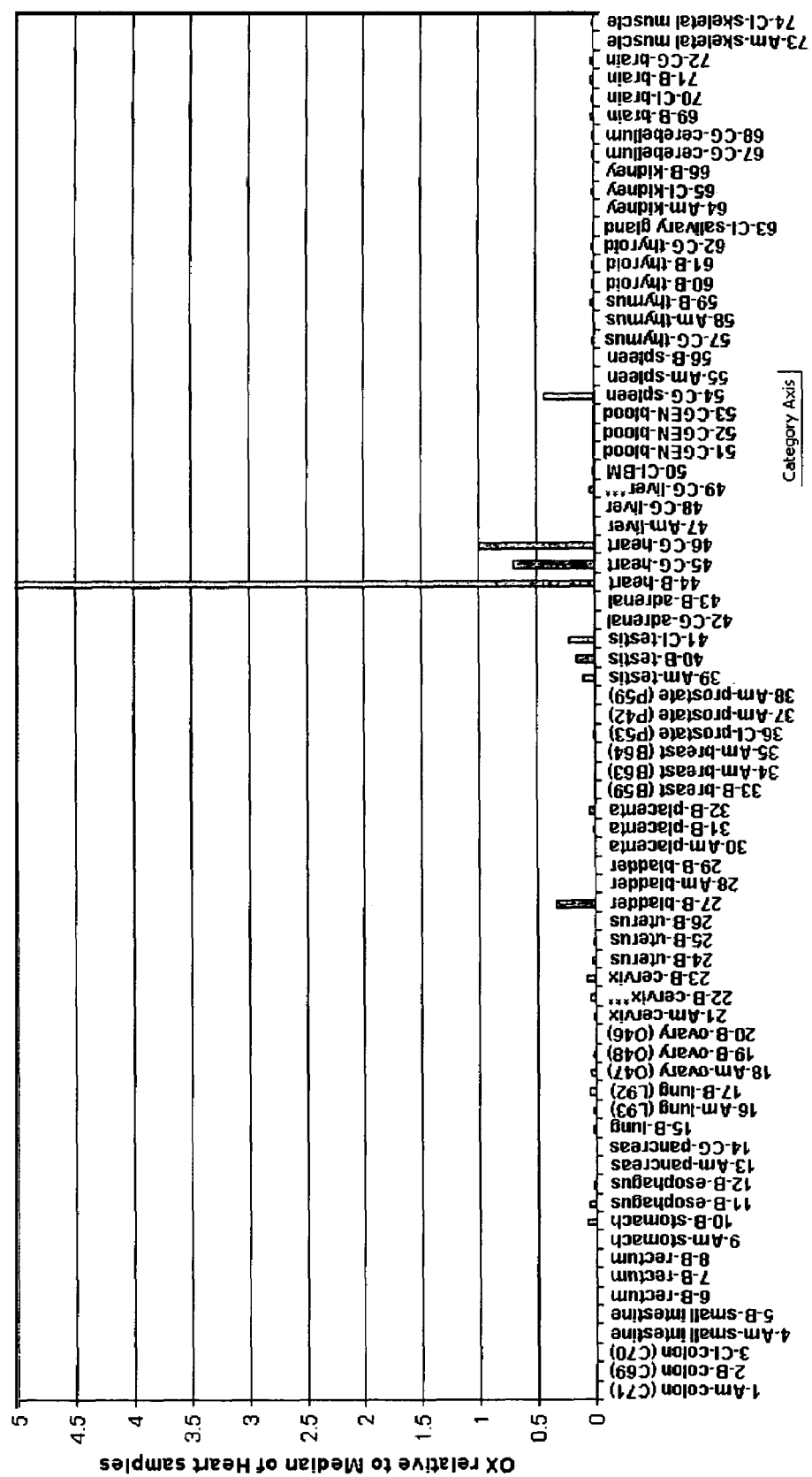

FIG. 21B is a histogram showing specific expression of the above-indicated TRIC_HUMAN Troponin I, cardiac muscle transcripts in heart tissue samples as opposed to other tissues. As is evident from FIG. 21B, the expression of TRIC_HUMAN Troponin I, cardiac muscle transcripts detectable by the above amplicon(s) in heart tissue samples was significantly higher than in the other samples (non-heart tissue sample Nos. 1-43, 47-74 Table 1 above, "Tissue samples in testing panel").

Primer pairs are also optionally and preferably encompassed within the present invention; for example, for the above experiment, the following primer pair was used as a non-limiting illustrative example only of a suitable primer pair: HUMTROPIA seg22F forward (SEQ ID NO:380) primer; and HUMTROPIA seg22R (SEQ ID NO:381) reverse primer.

The present invention also preferably encompasses any amplicon obtained through the use of any suitable primer pair; for example, for the above experiment, the following amplicon was obtained as a non-limiting illustrative example only of a suitable amplicon: HUMTROPIA seg22 (SEQ ID NO:382).

HUMTROPIA seg22 Forward primer (SEQ ID NO:380):
GTGGGACGCATGGGCA

-continued
HUMTROPIA seg22 Reverse primer (SEQ ID NO:381):
TTGTCCTGGGTCTCCTGGG

HUMTROPIA seg22 Amplicon (SEQ ID NO:382):
GTGGGACGCATGGGCAGCTCGGGTACCTTCGGGGTAGGGTGAGATGGCTG
GGACTTGGTCTCTGCCTGACCCCTTGCAGCTGCTTTTGGCTGCACATCCC
AGGAGACCCAGGACAA Expression of TRIC_HUMAN Troponin I, Cardiac Muscle HUMTROPIA Transcripts which are Detectable by Amplicon as Depicted in Sequence Name HUMTROPIA seg23-24-25 (SEQ ID NO:384) Specifically in Heart Tissue Expression of TRIC_HUMAN Troponin I, cardiac muscle transcripts detectable by or according to seg23-24-25 node(s), HUMTROPIA seg23-24-25 amplicon(s) and primers HUMTROPIA seg23-24-25F (SEQ ID NO:383) and HUMTROPIA seg23-24-25R (SEQ ID NO:384) was measured by real time PCR. This transcript relates to the known or WT protein (SEQ ID NO:351). In parallel the expression of four housekeeping genes—RPL19 (GenBank Accession No. NM_000981 (SEQ ID NO:437); RPL19 amplicon (SEQ ID NO:440)), TATA box (GenBank Accession No. NM_003194 (SEQ ID NO:441); TATA amplicon (SEQ ID NO:444)), Ubiquitin (GenBank Accession No. BC000449 (SEQ ID NO:445); amplicon—Ubiquitin-amplicon (SEQ ID NO:448)) and SDHA (GenBank Accession No. NM_004168 (SEQ ID NO:449); amplicon—SDHA-amplicon (SEQ ID NO:452)) was measured similarly. For each RT sample, the expression of the above amplicons was normalized to the geometric mean of the quantities of the housekeeping genes. The normalized quantity of each RT sample was then divided by the median of the quantities of the heart samples (Sample Nos. 44-46 Table 1, above), to obtain a value of relative expression for each sample relative to median of the heart samples.

Figure 22:
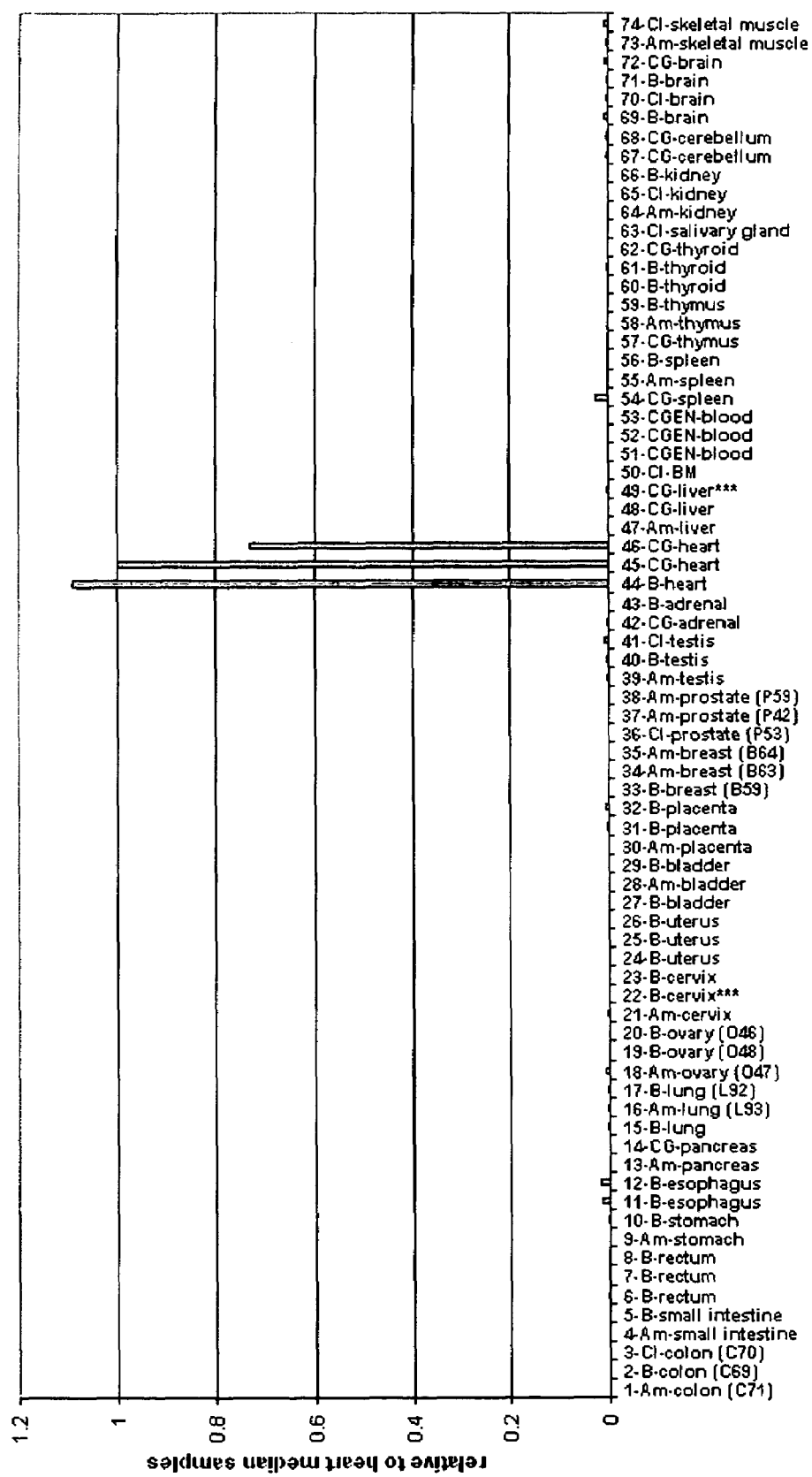
FIG. 22 is a histogram showing specific expression of the HUMTROPIA known protein sequence in heart tissue.

FIG. 22 is a histogram showing relative expression of the above-indicated TRIC_HUMAN Troponin I, cardiac muscle transcripts in heart tissue samples as opposed to other tissues.

As is evident from FIG. 22, the expression of TRIC_HUMAN Troponin I, cardiac muscle transcripts detectable by the above amplicon(s) in heart tissue samples was significantly higher than in the other samples (Sample Nos. 44-46 Table 1, "Tissue samples in testing panel").

Primer pairs are also optionally and preferably encompassed within the present invention; for example, for the above experiment, the following primer pair was used as a non-limiting illustrative example only of a suitable primer pair: HUMTROPIA seg23-24-25F (SEQ ID NO:383) forward primer; and HUMTROPIA seg23-24-25FR (SEQ ID NO:384) reverse primer.

The present invention also preferably encompasses any amplicon obtained through the use of any suitable primer pair; for example, for the above experiment, the following amplicon was obtained as a non-limiting illustrative example only of a suitable amplicon: HUMTROPIA seg23-24-25 (SEQ ID NO:384).

Forward primer
HUMTROPIA seg23-24-25F (SEQ ID NO:383):
AAGATCTTTGACCTTCGAGGCA

-continued
Reverse primer
HUMTROPIA seg23-24-25R (SEQ ID NO:384):
CTGCTTGAGGTGGGCCC Amplicon
HUMTROPIA seg23-24-25 (SEQ ID NO:385):
AAGATCTTTGACCTTCGAGGCAAGTTTAAGCGGCCCACCCTGCGGAGAGT
GAGGATCTCTGCAGATGCCATGATGCAGGCGCTGCTGGGGGCCCGGGCTA
AGGAGTCCCTGGACCTGCGGGCCCACCTCAAGCAG Additional Information—Variant ORFs With regard to the variants of this cluster, the following should be noted. Sequence T7 (also referred to herein as HUMTROPIA_PEA_2_T7 (SEQ ID NO:25) and troponin T7) has three open reading frames (ORFs) which are described in greater detail below.

The sequence in SEQ ID NO: 354 shows CDS-1 frame 1 from 148 to 406 length 259 (bp)=86 (aa) (similar to Troponin I N-ter)

MADGSSDAAREPRPAPAPIRRRSSNYRAYATEPHAKVGRGFLGAEYRRRR
DPRPWEWGEEPGLRRGRGLRGGASGAEFCRGSCSDW*

The sequence in SEQ ID NO: 355 shows CDS-2 frame 1 from 628 to 1183 length 556 (bp)=185 (aa) (similar to Troponin I C-terminal portion)

MILPCSISPWQKKSKISASRKLQLKTLLLQIAKQELEREAEERRGEKGRA
LSTRCQPLELAGLGFAELQDLCRQLHARVDKVDEERYDIEAKVTKNITEI
ADLTQKIFDLRGKFKRPTLRRVRISADAMMQALLGARAKESLDLRAHLKQ
VKKEDTEKENREVGDWRKNIDALSGMEGRKKKFES*

The sequence in SEQ ID NO: 356 shows CDS-3 frame 2 from 155 to 629 length 475 (bp) 158 (aa) (Not similar to Troponin I)

MGAAMRLGNLALHQPQSDAAPPTTALMPRSRTPRWDGASWGQSTGAGGIQ
DPGSGGRSQGCEGGGDYAEGLQGRSFAEGHARIGDSSLRAELRCPRTCLG
IDGKCLSKGRDPDWWMGMRGVASRRLRAQVGRGPKSGPAGFAGGVLRSPP
PSSPNPPP*

However, the presence of three ORFs could potentially complicate expression and also determination of expression of the desired protein. The first ORF starts at +1 of Troponin sequence (first "ATG" is +1 to +3), and the second ORF starts at +8, encoding a 158 amino acid protein. Since the 2nd ATG is located very close to the first one, there is a possibility that it will be expressed as well.

Figure 33:
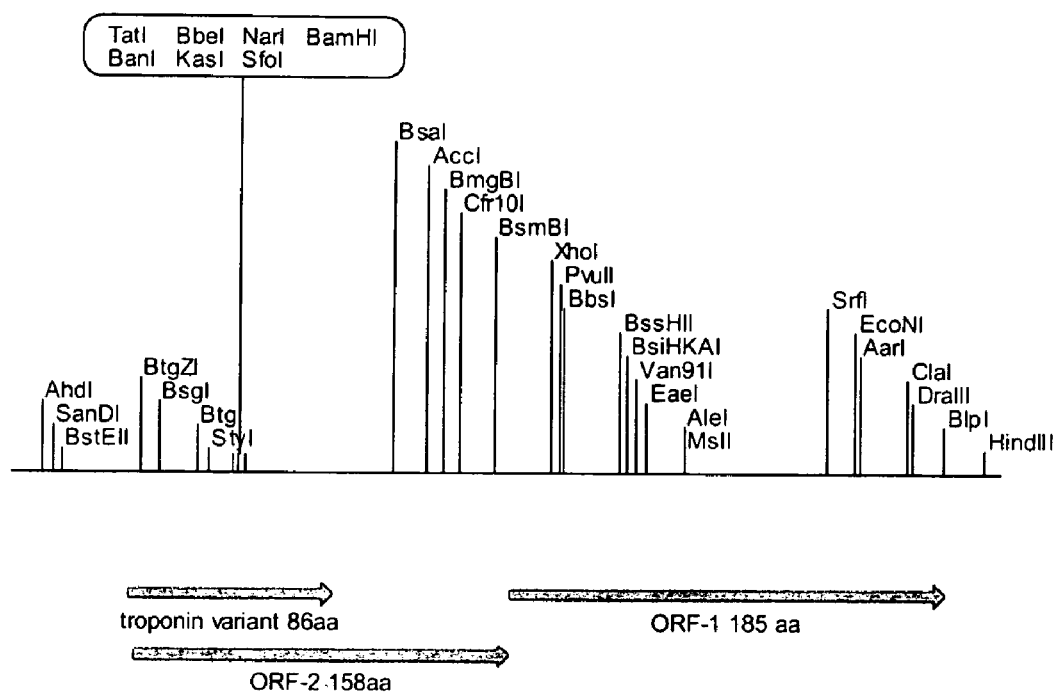
FIG. 33 shows a diagram of a troponin I variant, HUMTROPIA_T7, with regard to introducing a mutation to block an additional ORF.

In order to eliminate this possibility of expression of the long ORF, it is possible to optionally introduce two mutations (shown with regard to FIG. 33):

1. "c" at position 57 to "a"
2. "g" at position 111 to "a"

Both mutations are silent, so the protein sequence will not change.

Cloning and expression verification of a Troponin variant HUMTROPIA_PEA_2 T7 was performed as follows.

1. Full Length Validation
   1.1. RNA Preparation
   Human adult normal heart RNA pool (lot#A411077) was obtained from BioChain Inst. Inc. (Hayward, Calif dot 94545 USA dot biochain dot com). Total RNA samples were treated with DNaseI (Ambion Cat #1906).

1.2. RT PCR

Purified RNA (1 ug) was mixed with 150 ng Random Hexamer primers (Invitrogen Cat # 48190-011) and 500 uM dNTP (Takara, Cat # B9501-1) in a total volume of 15.6 ul DEPC-H2O (Beit Haemek, Cat # 01-852-1A). The mixture was incubated for 5 min at 65° C. and then quickly chilled on ice. Thereafter, 5 ul of 5× SuperscriptII first strand buffer (Invitrogen, Cat # Y00146), 2.4 ul 0.1M DTT (Invitrogen, Cat #Y00147) and 40 units RNasin (Promega, Cat # N251A) were added, and the mixture was incubated for 2 min at 42° C. Then, 1 ul (200 units) of SuperscriptII (Invitrogen, Cat #18064-022) was added and the reaction was incubated for 50 min at 42° C. and then inactivated at 70° C. for 15 min. The resulting cDNA was diluted 1:20 in TE buffer (10 mM Tris pH=8, 1 mM EDTA pH=8).

1.3. RT-PCR Analysis cDNA (5 ul), prepared as described above, was used as a template in PCR reactions. The amplification was done using AccuPower PCR PreMix (Bioneer, Korea, Cat# K2016), under the following conditions: 1 ul—of each primer (10 uM)

```
Tropfor  CCCTCACTGACCCTCCAAAC    (SEQ ID NO: 357)

TropRev  CTTCCCATCTATCCCTAAGC    (SEQ ID NO: 358)
``` plus 13 ul —H2O were added into AccuPower PCR PreMix tube with a reaction program of 5 minutes at 94° C.; 29 cycles of: [30 seconds at 94° C., 30 seconds at 52° C., 40 seconds at 72° C.] and 10 minutes at 72° C. At the end of the PCR amplification, products were analyzed on agarose gels stained with ethidium bromide and visualized with UV light. PCR product was extracted from the gel using QiaQuick™ gel extraction kit (Qiagen™, Cat #28706). The extracted DNA product then served as a template for secondary PCR reaction under the following conditions. 5 ul—Amplification ×10 buffer (Invitrogen Cat # 11708021); 10 ul—purified DNA; 1 ul—dNTPs (10 mM each); 1 ul MgSO4 (50 mM) 5 μl enhancer solution (Invitrogen, Cat # 11708021); 1 ul—of each primer (10 uM); 26 ul—H₂O and 1.25 units of Taq polymerase [Platinum Pfx DNA polymerase (Invitrogen, Cat#11708021)] in a total reaction volume of 50 ul. Amplification was performed with an initial denaturation step at 94° C. for 3 minutes followed by 29 cycles of [94° C. for 30 seconds, 55° C. for 30 seconds, 68° C. for 40 seconds] and 10 minutes at 68° C. At the end of the PCR amplification, products were analyzed on agarose gels stained with ethidium bromide and visualized with UV light. PCR product was extracted from gel using QiaQuick™ gel extraction kit. The extracted DNA product (FIG. 34) was sequenced by direct sequencing using the gene specific primers from above (Hy-Labs, Israel), resulting in the expected sequence of Troponin variant (FIG. 35).

Figure 34:
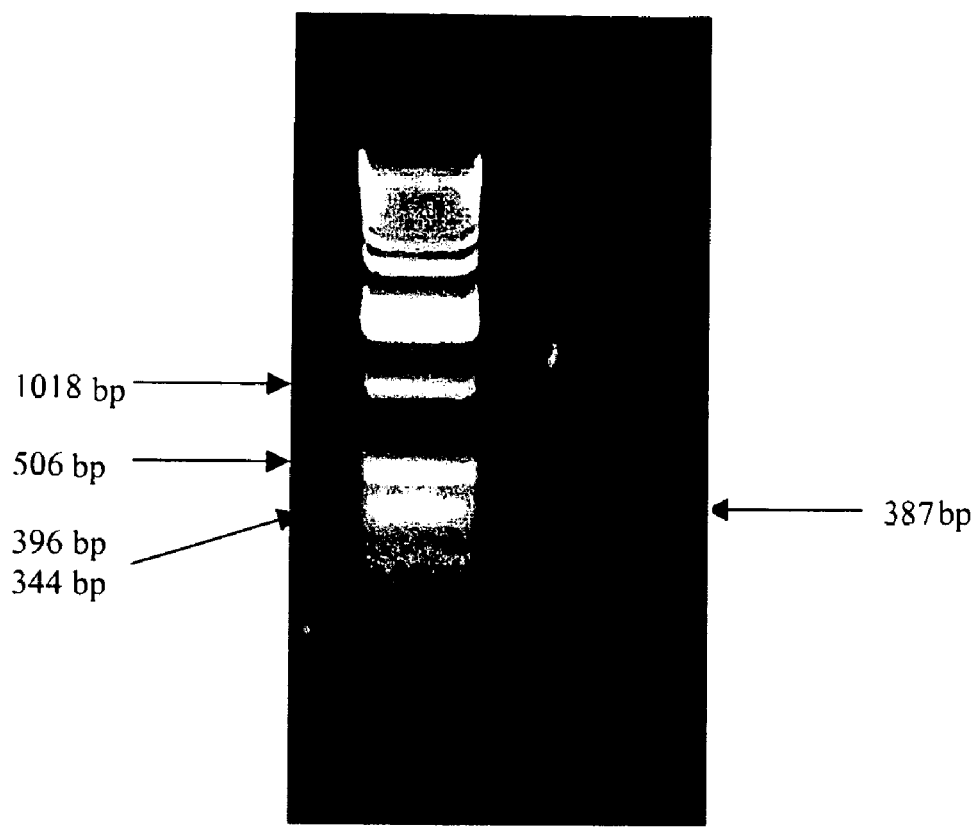
FIG. 34 shows Troponin PCR product after second amplification reaction: Lane 1: 1 Kb MW marker (GibcoBRL Cat #15615-016) and Lane 2: PCR product.

It was concluded that the predicted Troponin variant is indeed a naturally expressed variant in a normal human tissue as shown in FIG. 34.

2. Cloning of Troponin Variant into Bacterial Expression Vector

The Troponin splice variant coding sequence was prepared for cloning by PCR amplification using the fragment described above as template and Platinum Pfx DNA polymerase (Invitrogen Cat # 11708021) under the following conditions: 5 μl—Amplification ×10 buffer (Invitrogen Cat # 11708021); 2 μl—PCR product from above; 1 μl—dNTPs (10 mM each); 1 μl MgSO4 (50 mM) 5 μl enhancer solution (Invitrogen Cat # 11708021); 33 μl—H₂O; 1 μl—of each primer (10 μM) and 1.25 units of Taq polymerase [Platinum Pfx DNA polymerase (Invitrogen Cat # 11708021)] in a total reaction volume of 50 μl with a reaction program of 3 minutes at 94° C.; 29 cycles of: [30 seconds at 94° C., 30 seconds at 58° C., 40 seconds at 68° C.] and 7 minutes at 68° C. The Primers listed below include specific sequences of the nucleotide sequence corresponding to the splice variant and NheI and HindIII restriction sites.

```
                                        (SEQ ID NO: 359)
Trop NheIfor-ACAGCTAGCATGGCGGATGGGAGCAGC (SEQ ID NO: 360)
TropHindIIIrev-CCTAAGCTTCACCAATCCGAGCATGAC
```

Figure 36:
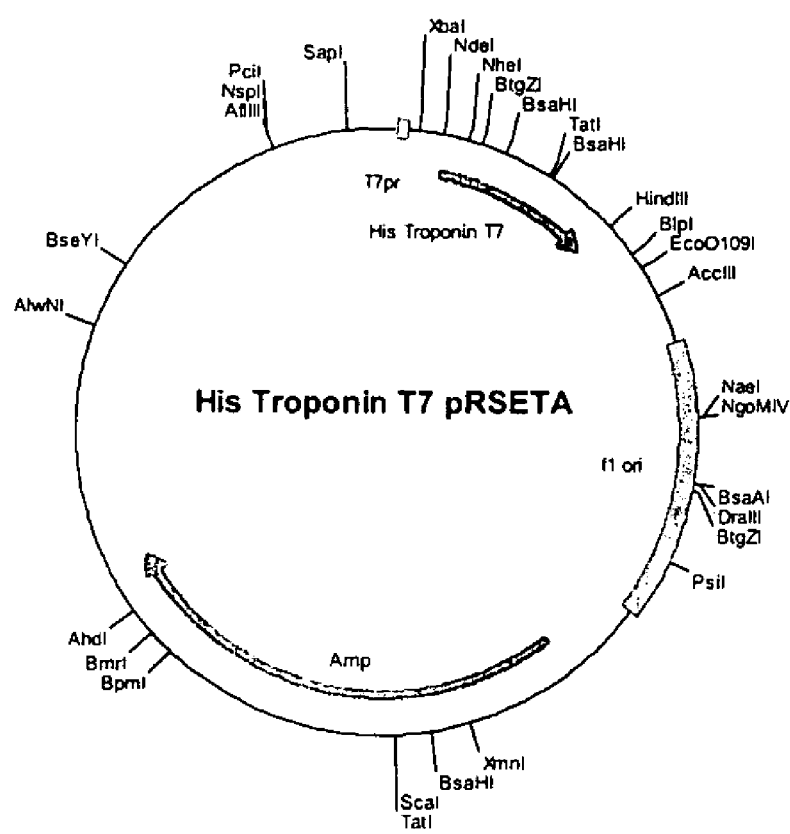
FIG. 36: plasmid map of His Troponin T7 pRSETA (SEQ ID NO:386).

The PCR product was then double digested with NheI and HindIII (New England Biolabs (UK) LTD), and inserted into pRSET-A (Invitrogen, Cat# V351-20), previously digested with the same enzymes, in-frame to an N-terminal 6His-tag, to give HisTroponin T7 pRSET (FIG. 36; (SEQ ID NO:386)). The coding sequence encodes for a protein having the 6His-tag at the N' end (6His residues in a row at one end of the protein), and 8 additional amino acids encoded by the pRSET vector.

The sequence of the Troponin insert in the final plasmid, as well as its flanking regions, were verified by sequencing and found to be identical to the desired sequences. The complete sequence of His Troponin T7 pRESTA is shown in FIG. 37 (SEQ ID NO:386).

FIG. 38 shows the translated sequence of Troponin variant with the location of the His-tag marked (SEQ ID NO:387).

3. Bacterial Cell Growth and Induction of Protein Expression

HisTroponin pRSETA DNA was transformed into competent BL21 Gold cells (Stratagene Cat#230134). Ampicillin resistant transformants were screened and positive clones were further analyzed by restriction enzyme digestion and sequence verification.

Cells containing the HisTroponin T7 pRSET vector or empty pRSET vector (as negative control) were grown in LB medium, supplemented with Ampicillin (50 μg/ml) and chloramphenicol (34 μg/ml). Cells were grown until $O.D._{600\ nm}$ reaches 0.5. This value was reached in about 3 hours. 1 mM IPTG (Roche, Cat #724815) was added and the cells were grown at 37° C. for additional 3 hours. 1 ml of each culture was removed for gel analysis at $T_0$ and $T_3$.

3.1. Coomassie Staining and Western Blotting Results

Figure 39A:
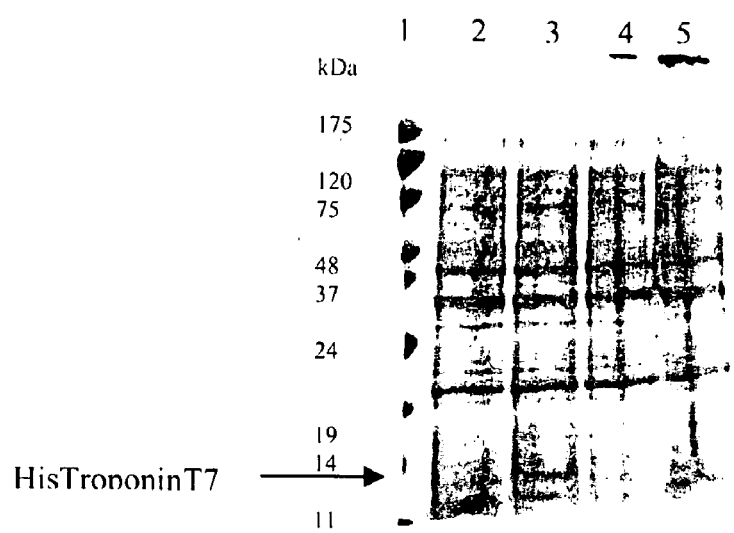
FIG. 39a shows Coomassie staining analysis of SDS-PAGE containing recombinant HisTroponin; lane 1: Molecular weight marker (ProSieve color, Cambrex, Cat #50550); lane 2: HisTroponinT7 pRSETA (SEQ ID NO:386) T0; lane 3: pRSET A T3; lane 4: pRSET empty vector T0 (negative control); lane 5: pRSET empty vector T3 (negative control).
Figure 39B:
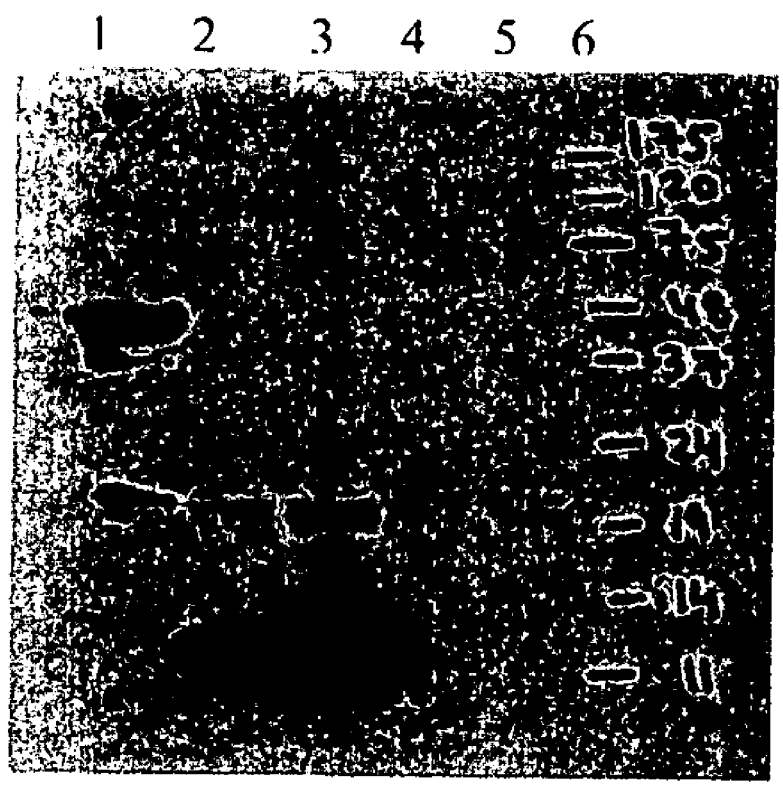
FIG. 39b shows a Western blot analysis of recombinant HisTroponin: lane 1: His positive control protein; lane 2: HisTroponinT7 pRSETA (SEQ ID NO:386) T0; lane 3: HisTroponinT7 pRSETA T3; lane 4: pRSET empty vector T0 (negative control); lane 5: pRSET empty vector T3 (negative control) and lane 6: molecular weight marker (ProSieve color, Cambrex, Cat #50550).

The time course of small-scale expression of Troponin in BL21Gold is demonstrated in FIG. 39a-b. The expression of a recombinant protein with the appropriate molecular weight (11 kDa) was detected both by Coomassie staining (FIG. 39a) and by Western blot using anti His-antibodies (BD Clontech, Ref 631212) (FIG. 39b). It was concluded that the protein encoded by Troponin variant T7 could be expressed in bacterial cells.

Description for Cluster HUMSMCK

Cluster HUMSMCK features 5 transcript(s) and 14 segment(s) of interest, the names for which are given in Tables 1 and 2, respectively, the sequences themselves are given at the end of the application. The selected protein variants are given in table 3.

TABLE 1

Transcripts of interest

| Transcript Name | Seq ID No. |
|---|---|
| HUMSMCK_T5 | 26 |
| HUMSMCK_T6 | 27 |
| HUMSMCK_T7 | 28 |
| HUMSMCK_T9 | 29 |
| HUMSMCK_T11 | 30 |

TABLE 2

Segments of interest

| Segment Name | Seq ID No. |
|---|---|
| HUMSMCK_node_0 | 150 |
| HUMSMCK_node_7 | 151 |
| HUMSMCK_node_12 | 152 |
| HUMSMCK_node_17 | 153 |
| HUMSMCK_node_22 | 154 |
| HUMSMCK_node_23 | 155 |
| HUMSMCK_node_25 | 156 |
| HUMSMCK_node_26 | 157 |
| HUMSMCK_node_28 | 158 |
| HUMSMCK_node_29 | 159 |
| HUMSMCK_node_32 | 160 |
| HUMSMCK_node_11 | 161 |
| HUMSMCK_node_14 | 162 |
| HUMSMCK_node_19 | 163 |

TABLE 3

Proteins of interest

| Protein Name | Seq ID No. | Corresponding Transcript(s) |
|---|---|---|
| HUMSMCK_P4 | 305 | HUMSMCK_T5 (SEQ ID NO: 26) |
| HUMSMCK_P5 | 306 | HUMSMCK_T6 (SEQ ID NO: 27) |
| HUMSMCK_P6 | 307 | HUMSMCK_T7 (SEQ ID NO: 28); HUMSMCK_T11 (SEQ ID NO: 30) |
| HUMSMCK_P8 | 308 | HUMSMCK_T9 (SEQ ID NO: 29) |

These sequences are variants of the known protein Creatine kinase, sarcomeric mitochondrial precursor (SEQ ID NO:388) (SwissProt accession identifier KCRS_HUMAN; known also according to the synonyms EC 2.7.3.2; S-MtCK; Mib-CK; Basic-type mitochondrial creatine kinase), referred to herein as the previously known protein.

Protein Creatine kinase, sarcomeric mitochondrial precursor (SEQ ID NO:388) is known or believed to have the following function(s): Reversibly catalyzes the transfer of phosphate between ATP and various phosphogens (e.g. creatine phosphate). Creatine kinase isoenzymes play a central role in energy transduction in tissues with large, fluctuating energy demands, such as skeletal muscle, heart, brain and spermatozoa. The sequence for protein Creatine kinase, sarcomeric mitochondrial precursor is given at the end of the application, as "Creatine kinase, sarcomeric mitochondrial precursor amino acid sequence" (SEQ ID NO:388). Known polymorphisms for this sequence are as shown in Table 4.

TABLE 4

Amino acid mutations for Known Protein

| SNP position(s) on amino acid sequence | Comment |
|---|---|
| 74 | S -> A |

Protein Creatine kinase, sarcomeric mitochondrial precursor (SEQ ID NO:388) localization is believed to be Mitochondrial inner membrane; outer side.

The following GO Annotation(s) apply to the previously known protein. The following annotation(s) were found: energy pathways; muscle contraction, which are annotation(s) related to Biological Process; creatine kinase; transferase, transferring phosphorus-containing groups, which are annotation(s) related to Molecular Function; and mitochondrion, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

The heart-selective diagnostic marker prediction engine provided the following results with regard to cluster HUMSMCK. Predictions were made for selective expression of transcripts of this cluster in heart tissue, according to the previously described methods. The numbers on the y-axis of FIG. 23 refer to weighted expression of ESTs in each category, as "parts per million" (ratio of the expression of ESTs for a particular cluster to the expression of all ESTs in that category, according to parts per million).

Figure 23:
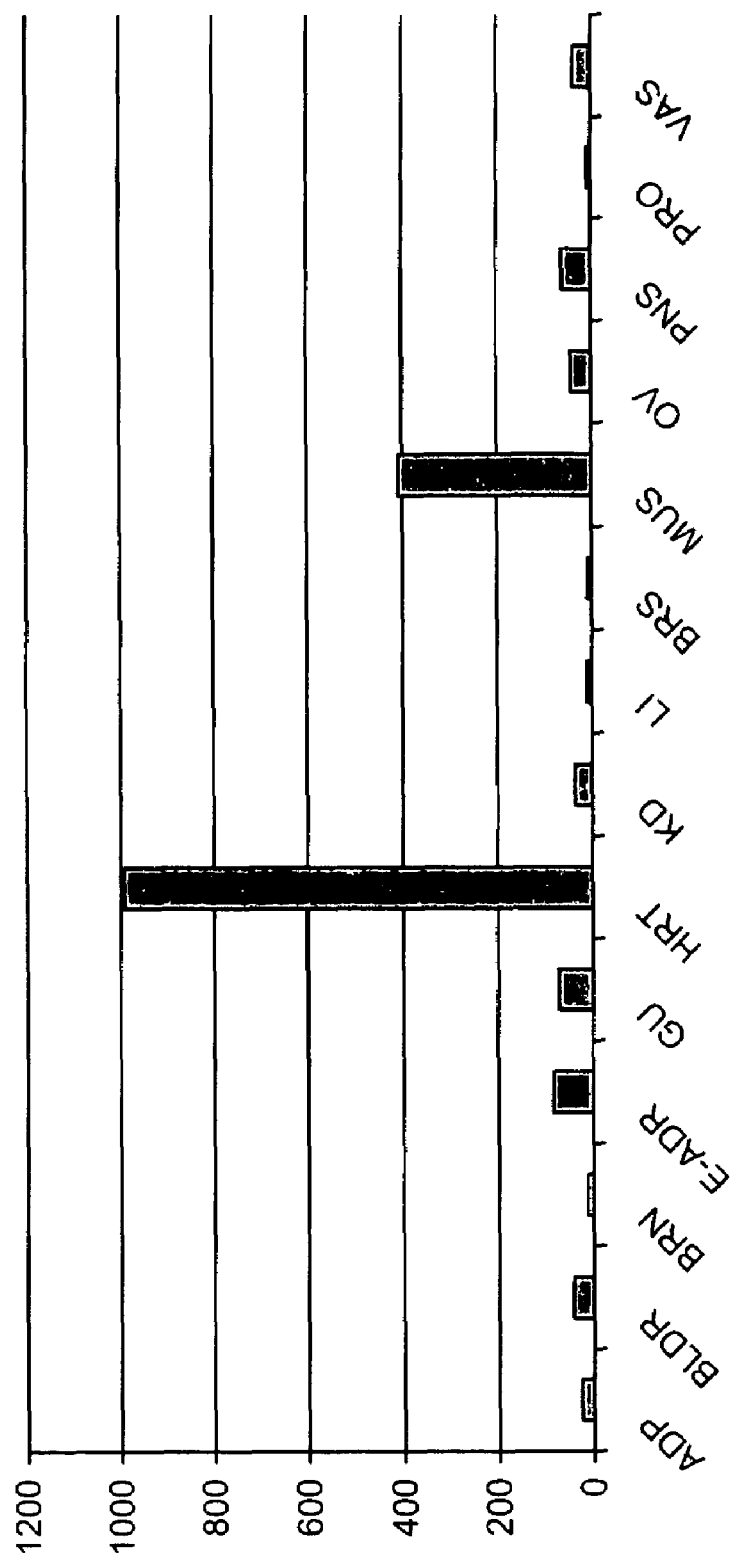
FIG. 23 is a histogram showing ESTs concerning the number of heart tissue-specific clones in libraries/sequences
Figure 24:
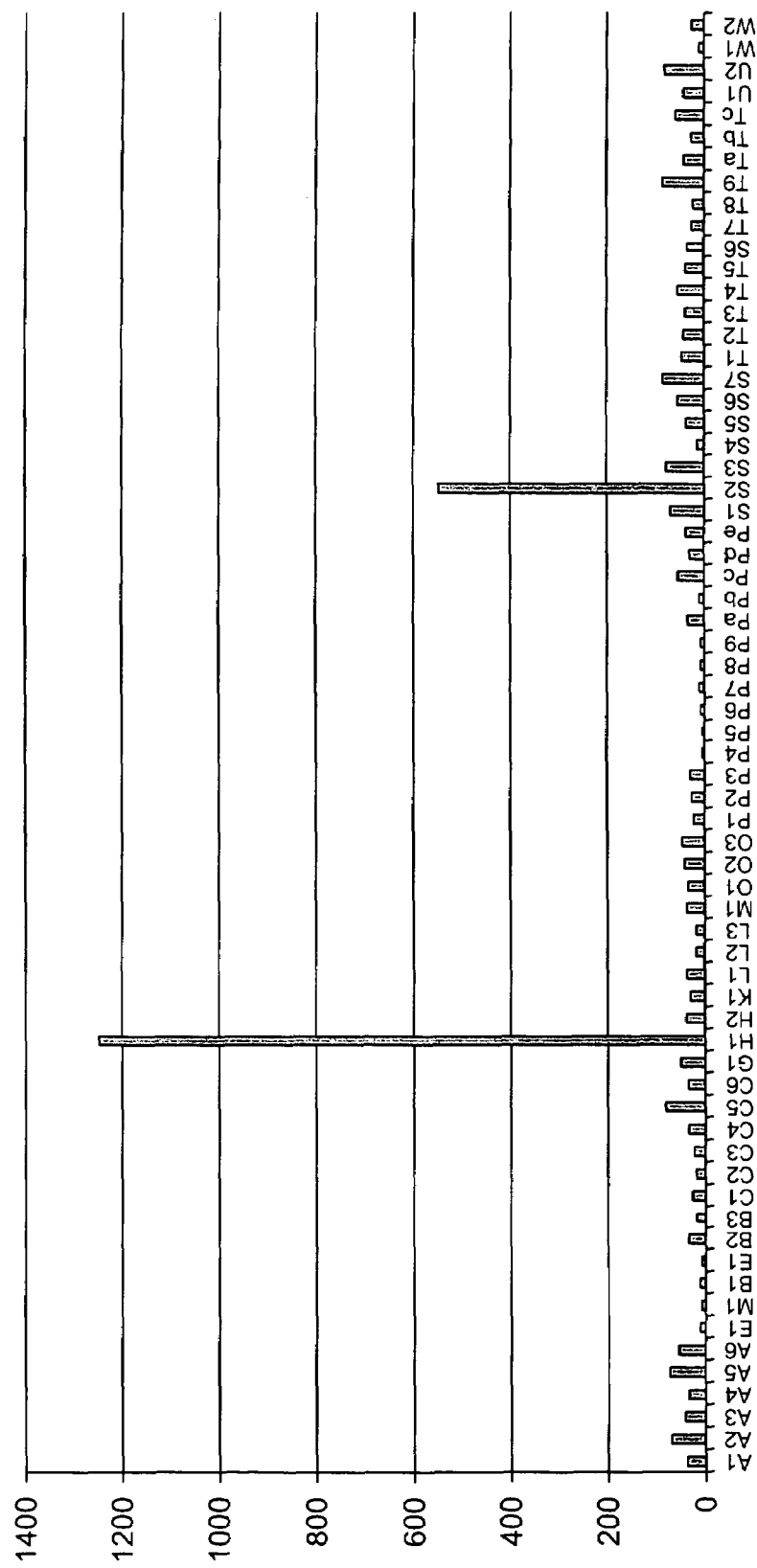
FIG. 24 is a histogram concerning the actual expression of oligonucleotides in various tissues, pob 205295_at (SEQ ID NO:393), including heart tissue.

Overall, the following results were obtained as shown with regard to the histogram in FIG. 23, concerning the number of heart-specific clones in libraries/sequences; as well as with regard to the histogram in FIG. 24, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 18.1; the ratio of expression of the cluster in heart specific ESTs to the overall expression of the cluster in muscle-specific ESTs which was found to be 2.4; and fisher exact test P-values were computed both for library and weighted clone counts to check that the counts are statistically significant, and were found to be 3.60E-23.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 18.1, which clearly supports specific expression in heart tissue.

As noted above, cluster HUMSMCK features 5 transcript(s), which were listed in Table 1 above. These transcript(s) encode for protein(s) which are variant(s) of protein Creatine kinase, sarcomeric mitochondrial precursor (SEQ ID NO:388). A description of each variant protein according to the present invention is now provided.

Variant protein HUMSMCK_P4 (SEQ ID NO:305) according to the present invention has an amino acid sequence as given at the end of the application; it is encoded by transcript(s) HUMSMCK_T5 (SEQ ID NO:26). An alignment is given to the known protein (Creatine kinase, sarcomeric mitochondrial precursor (SEQ ID NO:388)) at the end of the application. One or more alignments to one or more previously published protein sequences are given at the end of the application. A brief description of the relationship of the variant protein according to the present invention to each such aligned protein is as follows:

Comparison report between HUMSMCK_P4 (SEQ ID NO:305) and KCRS_HUMAN_V1 (SEQ ID NO:347):

1. An isolated chimeric polypeptide encoding for HUMSMCK_P4 (SEQ ID NO:305), comprising a first amino acid sequence being at least 90% homologous to MASIFSKLLTGRNASLLFATMGTSVLT-TGYLLNRQKVCAEVREQPRLFPPSADYPDLRK HNNCMAECLTPAIYAKLRNKVTP-NGYTLDQCIQTGVDNPGHPFIKTVGMVAGDEESYE VFADLFDPVIKLRHNGYDPRVMKHTTDL-DASKITQGQFDEHYVLSSRVRTGRSIRGLSL PPAC-TRAERREVENVAITALEGLKGD-LAGRYYKLSEMTEQDQQRLIDDHFLFDKPVSPL LTCAGMARDWPDARGIWHNYDKTFLI-WINEEDHTRVISMEKGGNMKRVFERFCRGLK EVER-LIQERGWEFMWNERLGYILTCPSNLGT-GLRAGVHVRIPKLSKDPRFSKILENLRLQ KRGTGGVDTAAVADVYDISNIDRIGRSEV corresponding to amino acids 1-381 of KCRS_HUMAN_V1 (SEQ ID NO:347), which also corresponds to amino acids 1-381 of HUMSMCK_P4 (SEQ ID NO:305), and a second amino acid sequence being at least 70%, optionally at least 80%, preferably at least 85%, more preferably at least 90% and most preferably at least 95% homologous to a polypeptide having the sequence TSLSLS (SEQ ID NO:415) corresponding to amino acids 382-387 of HUMSMCK_P4 (SEQ ID NO:305), wherein said first amino acid sequence and second amino acid sequence are contiguous and in a sequential order.

2. An isolated polypeptide encoding for a tail of HUMSMCK_P4 (SEQ ID NO:305), comprising a polypeptide being at least 70%, optionally at least about 80%, preferably at least about 85%, more preferably at least about 90% and most preferably at least about 95% homologous to the sequence TSLSLS (SEQ ID NO:415) in HUMSMCK_P4 (SEQ ID NO:305).

It should be noted that the known protein sequence (KCRS_HUMAN; SEQ ID NO:388) has one or more changes than the sequence given at the end of the application and named as being the amino acid sequence for KCRS_HUMAN_V1 (SEQ ID NO:347). These changes were previously known to occur and are listed in the table below.

TABLE 5

| Changes to KCRS_HUMAN_V1 (SEQ ID NO: 347) | |
|---|---|
| SNP position(s) on amino acid sequence | Type of change |
| 75 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellular because of manual inspection of known protein localization and/or gene structure.

Variant protein HUMSMCK_P4 (SEQ ID NO:305) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein HUMSMCK_P4 (SEQ ID NO:305) sequence provides support for the deduced sequence of this variant protein according to the present invention).

TABLE 6

| Amino acid mutations | | |
|---|---|---|
| SNP position(s) on amino acid sequence | Alternative amino acid(s) | Previously known SNP? |
| 59 | K -> | No |
| 60 | H -> | No |
| 74 | A -> S | Yes |
| 117 | E -> * | No |
| 117 | E -> | No |
| 249 | R -> | No |

Variant protein HUMSMCK_P4 (SEQ ID NO:305) is encoded by the following transcript(s): HUMSMCK_T5 (SEQ ID NO:26), for which the sequence(s) is/are given at the end of the application. The coding portion of transcript HUMSMCK_T5 (SEQ ID NO:26) is shown in bold; this coding portion starts at position 1305 and ends at position 2465. The transcript also has the following SNPs as listed in Table 7 (given according to their position on the nucleotide sequence, with the alternative nucleic acid listed; the last column indicates whether the SNP is known or not; the presence of known SNPs in variant protein HUMSMCK_P4 (SEQ ID NO:305) sequence provides support for the deduced sequence of this variant protein according to the present invention).

TABLE 7

| Nucleic acid SNPs | | |
|---|---|---|
| SNP position on nucleotide sequence | Alternative nucleic acid | Previously known SNP? |
| 223 | A -> C | Yes |
| 545 | G -> T | Yes |
| 1481 | G -> | No |
| 1482 | C -> | No |
| 1524 | G -> T | Yes |
| 1653 | G -> | No |
| 1653 | G -> T | No |
| 2050 | G -> | No |
| 2228 | T -> C | No |
| 2231 | G -> A | No |
| 2489 | C -> T | Yes |

Variant protein HUMSMCK_P5 (SEQ ID NO:306) according to the present invention has an amino acid sequence as given at the end of the application; it is encoded by transcript(s) HUMSMCK_T6 (SEQ ID NO:27). An alignment is given to the known protein (Creatine kinase, sarcomeric mitochondrial precursor (SEQ ID NO:388)) at the end of the application. One or more alignments to one or more previously published protein sequences are given at the end of the application. A brief description of the relationship of the variant protein according to the present invention to each such aligned protein is as follows:

Comparison report between HUMSMCK_P5 (SEQ ID NO:306) and KCRS_HUMAN_V1 (SEQ ID NO:347):

1. An isolated chimeric polypeptide encoding for HUMSMCK_P5 (SEQ ID NO:306), comprising a first amino acid sequence being at least 90% homologous to MASIFSKLLTGRNASLLFATMGTSVLT-TGYLLNRQKVCAEVREQPRLFPPSADYPDLRK HNNCMAECLTPAIYAKLRNKVTP-NGYTLDQCIQTGVDNPGHPFIKTVGMVAGDEESYE VFADLFDPVIKLRHNGYDPRVMKHTTDL-DASKITQGQFDEHYVLSSRVRTGRSIRGLSL PPAC-TRAERREVENVAITALEGLKGD-LAGRYYKLSEMTEQDQQRLIDDHFLFDKPVSPL LTCAGMARDWPDARGIWHNYDKTFLI-WINEEDHTRVISMEKGGNMKRVFERFCRGLK EVER-LIQERGWEFMWNERLGYILTCPSNLGT-GLRAGVHVRIPKLSK corresponding to amino acids 1-338 of KCRS_HUMAN_V1 (SEQ ID NO:347), which also corresponds to amino acids 1-338 of HUMSMCK_P5 (SEQ ID NO:306), and a second amino acid sequence being at least 70%, optionally at least 80%, preferably at least 85%, more preferably at least 90% and most preferably at least 95% homologous to a polypeptide having the sequence VLLCAQWP (SEQ ID NO:416) corresponding to amino acids 339-346 of HUMSMCK_P5 (SEQ ID NO:306), wherein said first amino acid sequence and second amino acid sequence are contiguous and in a sequential order.

2. An isolated polypeptide encoding for a tail of HUMSMCK_P5 (SEQ ID NO:306), comprising a polypeptide being at least 70%, optionally at least about 80%, preferably at least about 85%, more preferably at least about 90% and most preferably at least about 95% homologous to the sequence VLLCAQWP (SEQ ID NO:416) in HUMSM-CK_P5 (SEQ ID NO:306).

It should be noted that the known protein sequence (KCRS_HUMAN (SEQ ID NO:388)) has one or more changes than the sequence given at the end of the application and named as being the amino acid sequence for KCR-S_HUMAN_V1 (SEQ ID NO:347). These changes were previously known to occur and are listed in the table below.

TABLE 8

Changes to KCRS_HUMAN_V1 (SEQ ID NO: 347)

| SNP position(s) on amino acid sequence | Type of change |
|---|---|
| 75 | Conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellular because of manual inspection of known protein localization and/or gene structure.

Variant protein HUMSMCK_P5 (SEQ ID NO:306) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein HUMSMCK_P5 (SEQ ID NO:306) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 59 | K -> | No |
| 60 | H -> | No |
| 74 | A -> S | Yes |
| 117 | E -> * | No |
| 117 | E -> | No |
| 249 | R -> | No |

Variant protein HUMSMCK_P5 (SEQ ID NO:306) is encoded by the following transcript(s): HUMSMCK_T6 (SEQ ID NO:27), for which the sequence(s) is/are given at the end of the application. The coding portion of transcript HUMSMCK_T6 (SEQ ID NO:27) is shown in bold; this coding portion starts at position 1305 and ends at position 2342. The transcript also has the following SNPs as listed in Table 10 (given according to their position on the nucleotide sequence, with the alternative nucleic acid listed; the last column indicates whether the SNP is known or not; the presence of known SNPs in variant protein HUMSMCK_P5 (SEQ ID NO:306) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 223 | A -> C | Yes |
| 545 | G -> T | Yes |
| 1481 | G -> | No |
| 1482 | C -> | No |
| 1524 | G -> T | Yes |
| 1653 | G -> | No |
| 1653 | G -> T | No |
| 2050 | G -> | No |
| 2228 | T -> C | No |
| 2231 | G -> A | No |

Variant protein HUMSMCK_P6 (SEQ ID NO:307) according to the present invention has an amino acid sequence as given at the end of the application; it is encoded by transcript(s) HUMSMCK_T7 (SEQ ID NO:28) and HUMSMCK_T1 (SEQ ID NO:30). An alignment is given to the known protein (Creatine kinase, sarcomeric mitochondrial precursor (SEQ ID NO:388)) at the end of the application. One or more alignments to one or more previously published protein sequences are given at the end of the application. A brief description of the relationship of the variant protein according to the present invention to each such aligned protein is as follows:

Comparison report between HUMSMCK_P6 (SEQ ID NO:307) and KCRS_HUMAN_V1 (SEQ ID NO:347):

1. An isolated chimeric polypeptide encoding for HUMSMCK_P6 (SEQ ID NO:307), comprising a first amino acid sequence being at least 90% homologous to MASIFSKLLTGRNASLLFATMGTSVLT-TGYLLNRQKVCAEVREQPRLFPPSADYPDLRK HNNCMAECLTPAIYAKLRNKVTP-NGYTLDQCIQTGVDNPGHPFIKTVGMVAGDEESYE VFADLFDPVIKLRHNGYDPRVMKHTTDL-
DASKITQGQFDEHYVLSSRVRTGRSIRGLSL PPAC-
TRAERREVENVAITALEGLKGD-
LAGRYYKLSEMTEQDQQRLID corresponding to amino acids 1-223 of KCRS_HUMAN_V1 (SEQ ID NO:347), which also corresponds to amino acids 1-223 of HUMSMCK_P6 (SEQ ID NO:307), and a second amino acid sequence being at least 70%, optionally at least 80%, preferably at least 85%, more preferably at least 90% and most preferably at least 95% homologous to a polypeptide having the sequence A corresponding to amino acids 224-224 of HUMSMCK_P6 (SEQ ID NO:307), wherein said first amino acid sequence and second amino acid sequence are contiguous and in a sequential order.

It should be noted that the known protein sequence (KCRS_HUMAN (SEQ ID NO:388)) has one or more changes than the sequence given at the end of the application and named as being the amino acid sequence for KCRS_HUMAN_V1 (SEQ ID NO:347). These changes were previously known to occur and are listed in the table below.

TABLE 11

Changes to KCRS_HUMAN_V1 (SEQ ID NO: 347)

| SNP position(s) on amino acid sequence | Type of change |
|---|---|
| 75 | Conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellular because of manual inspection of known protein localization and/or gene structure.

Variant protein HUMSMCK_P6 (SEQ ID NO:307) also has the following non-silent SNPs (Single Nucleotide Polymorphisms) as listed in Table 12, (given according to their position(s) on the amino acid sequence, with the alternative amino acid(s) listed; the last column indicates whether the SNP is known or not; the presence of known SNPs in variant protein HUMSMCK_P6 (SEQ ID NO:307) sequence provides support for the deduced sequence of this variant protein according to the present invention).

TABLE 12

Amino acid mutations

| SNP position(s) on amino acid sequence | Alternative amino acid(s) | Previously known SNP? |
|---|---|---|
| 59 | K -> | No |
| 60 | H -> | No |
| 74 | A -> S | Yes |
| 117 | E -> * | No |
| 117 | E -> | No |

Variant protein HUMSMCK_P6 (SEQ ID NO:307) is encoded by the following transcript(s): HUMSMCK_T7 (SEQ ID NO:28) and HUMSMCK_T11 (SEQ ID NO:30), for which the sequence(s) is/are given at the end of the application.

The coding portion of transcript HUMSMCK_T7 (SEQ ID NO:28) is shown in bold; this coding portion starts at position 1305 and ends at position 1976. The transcript also has the following SNPs as listed in Table 13 (given according to their position on the nucleotide sequence, with the alternative nucleic acid listed; the last column indicates whether the SNP is known or not; the presence of known SNPs in variant protein HUMSMCK_P6 (SEQ ID NO:307) sequence provides support for the deduced sequence of this variant protein according to the present invention).

TABLE 13

Nucleic acid SNPs

| SNP position on nucleotide sequence | Alternative nucleic acid | Previously known SNP? |
|---|---|---|
| 223 | A -> C | Yes |
| 545 | G -> T | Yes |
| 1481 | G -> | No |
| 1482 | C -> | No |
| 1524 | G -> T | Yes |
| 1653 | G -> | No |
| 1653 | G -> T | No |
| 2142 | T -> C | No |
| 2145 | G -> A | No |
| 2398 | C -> A | Yes |
| 2521 | G -> A | Yes |

The coding portion of transcript HUMSMCK_T11 (SEQ ID NO:30) is shown in bold; this coding portion starts at position 1305 and ends at position 1976. The transcript also has the following SNPs as listed in Table 14 (given according to their position on the nucleotide sequence, with the alternative nucleic acid listed; the last column indicates whether the SNP is known or not; the presence of known SNPs in variant protein HUMSMCK_P6 (SEQ ID NO:307) sequence provides support for the deduced sequence of this variant protein according to the present invention).

TABLE 14

Nucleic acid SNPs

| SNP position on nucleotide sequence | Alternative nucleic acid | Previously known SNP? |
|---|---|---|
| 223 | A -> C | Yes |
| 545 | G -> T | Yes |
| 1481 | G -> | No |
| 1482 | C -> | No |
| 1524 | G -> T | Yes |
| 1653 | G -> | No |
| 1653 | G -> T | No |

Variant protein HUMSMCK_P8 (SEQ ID NO:308) according to the present invention has an amino acid sequence as given at the end of the application; it is encoded by transcript(s) HUMSMCK_T9 (SEQ ID NO:29). An alignment is given to the known protein (Creatine kinase, sarcomeric mitochondrial precursor (SEQ ID NO:388)) at the end of the application. One or more alignments to one or more previously published protein sequences are given at the end of the application. A brief description of the relationship of the variant protein according to the present invention to each such aligned protein is as follows:

Comparison report between HUMSMCK_P8 (SEQ ID NO:308) and KCRS_HUMAN_V1 (SEQ ID NO:347):

1. An isolated chimeric polypeptide encoding for HUMSMCK_P8 (SEQ ID NO:308), comprising a first amino acid sequence being at least 90% homologous to MASIFSKLLTGRNASLLFATMGTSVLT-
TGYLLNRQKVCAEVREQPRLFPPSADYPDLRK
HNNCMAECLTPAIYAKLRNKVTP- NGYTLDQCIQTGVDNPGHPFIKTVGMVAGDEESYE
VFADLFDPVIKLRHNGYDPRVMKHTTDL-
DASKITQGQFDEHYVLSSRVRTGRSIRGLSL PPAC-
TRAERREVENVAITALEGLKGD-
LAGRYYKLSEMTEQDQQRLIDDHFLFDKPVSPL
LTCAGMARDWPDARGIWHNYDKTFLI-
WINEEDHTRVISMEKGGNMKRVFERFCRGLK EV corresponding to amino acids 1-294 of KCRS_HUMAN_V1 (SEQ ID NO:347), which also corresponds to amino acids 1-294 of HUMSMCK_P8 (SEQ ID NO:308), and a second amino acid sequence being at least 70%, optionally at least 80%, preferably at least 85%, more preferably at least 90% and most preferably at least 95% homologous to a polypeptide having the sequence RCYLRFLDIY (SEQ ID NO:417) corresponding to amino acids 295-304 of HUMSMCK_P8 (SEQ ID NO:308), wherein said first amino acid sequence and second amino acid sequence are contiguous and in a sequential order.

2. An isolated polypeptide encoding for a tail of HUMSMCK_P8 (SEQ ID NO:308), comprising a polypeptide being at least 70%, optionally at least about 80%, preferably at least about 85%, more preferably at least about 90% and most preferably at least about 95% homologous to the sequence RCYLRFLDIY (SEQ ID NO:417) in HUMSMCK_P8 (SEQ ID NO:308).

It should be noted that the known protein sequence (KCRS_HUMAN (SEQ ID NO:388)) has one or more changes than the sequence given at the end of the application and named as being the amino acid sequence for KCRS_HUMAN_V1 (SEQ ID NO:347). These changes were previously known to occur and are listed in the table below.

TABLE 15

Changes to KCRS_HUMAN_V1 (SEQ ID NO: 347)

| SNP position(s) on amino acid sequence | Type of change |
|---|---|
| 75 | Conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellular because of manual inspection of known protein localization and/or gene structure.

Variant protein HUMSMCK_P8 (SEQ ID NO:308) also has the following non-silent SNPs (Single Nucleotide Polymorphisms) as listed in Table 16, (given according to their position(s) on the amino acid sequence, with the alternative amino acid(s) listed; the last column indicates whether the SNP is known or not; the presence of known SNPs in variant protein HUMSMCK_P8 (SEQ ID NO:308) sequence provides support for the deduced sequence of this variant protein according to the present invention).

TABLE 16

Amino acid mutations

| SNP position(s) on amino acid sequence | Alternative amino acid(s) | Previously known SNP? |
|---|---|---|
| 59 | K -> | No |
| 60 | H -> | No |

TABLE 16-continued

Amino acid mutations

| SNP position(s) on amino acid sequence | Alternative amino acid(s) | Previously known SNP? |
|---|---|---|
| 74 | A -> S | Yes |
| 117 | E -> * | No |
| 117 | E -> | No |
| 249 | R -> | No |

Variant protein HUMSMCK_P8 (SEQ ID NO:308) is encoded by the following transcript(s): HUMSMCK_T9 (SEQ ID NO:29), for which the sequence(s) is/are given at the end of the application. The coding portion of transcript HUMSMCK_T9 (SEQ ID NO:29) is shown in bold; this coding portion starts at position 1305 and ends at position 2216. The transcript also has the following SNPs as listed in Table 17 (given according to their position on the nucleotide sequence, with the alternative nucleic acid listed; the last column indicates whether the SNP is known or not; the presence of known SNPs in variant protein HUMSMCK_P8 (SEQ ID NO:308) sequence provides support for the deduced sequence of this variant protein according to the present invention).

TABLE 17

Nucleic acid SNPs

| SNP position on nucleotide sequence | Alternative nucleic acid | Previously known SNP? |
|---|---|---|
| 223 | A -> C | Yes |
| 545 | G -> T | Yes |
| 1481 | G -> | No |
| 1482 | C -> | No |
| 1524 | G -> T | Yes |
| 1653 | G -> | No |
| 1653 | G -> T | No |
| 2050 | G -> | No |

As noted above, cluster HUMSMCK features 14 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMSMCK_node_0 (SEQ ID NO:150) according to the present invention is supported by 38 libraries. The number of libraries was determined as previously described. This segment can be found in the following transcript(s): HUMSMCK_T5 (SEQ ID NO:26), HUMSMCK_T6 (SEQ ID NO:27), HUMSMCK_T7 (SEQ ID NO:28), HUMSMCK_T9 (SEQ ID NO:29) and HUMSMCK_T11 (SEQ ID NO:30). Table 18 below describes the starting and ending position of this segment on each transcript.

TABLE 18

Segment location on transcripts

| Transcript name | Segment starting position | Segment ending position |
|---|---|---|
| HUMSMCK_T5 (SEQ ID NO: 26) | 1 | 1284 |
| HUMSMCK_T6 (SEQ ID NO: 27) | 1 | 1284 |

TABLE 18-continued

Segment location on transcripts

| Transcript name | Segment starting position | Segment ending position |
|---|---|---|
| HUMSMCK_T7 (SEQ ID NO: 28) | 1 | 1284 |
| HUMSMCK_T9 (SEQ ID NO: 29) | 1 | 1284 |
| HUMSMCK_T11 (SEQ ID NO: 30) | 1 | 1284 |

Segment cluster HUMSMCK_node_7 (SEQ ID NO:151) according to the present invention is supported by 47 libraries. The number of libraries was determined as previously described. This segment can be found in the following transcript(s): HUMSMCK_T5 (SEQ ID NO:26), HUMSMCK_T6 (SEQ ID NO:27), HUMSMCK_T7 (SEQ ID NO:28), HUMSMCK_T9 (SEQ ID NO:29) and HUMSMCK_T11(SEQ ID NO:30). Table 19 below describes the starting and ending position of this segment on each transcript.

TABLE 19

Segment location on transcripts

| Transcript name | Segment starting position | Segment ending position |
|---|---|---|
| HUMSMCK_T5 (SEQ ID NO: 26) | 1285 | 1456 |
| HUMSMCK_T6 (SEQ ID NO: 27) | 1285 | 1456 |
| HUMSMCK_T7 (SEQ ID NO: 28) | 1285 | 1456 |
| HUMSMCK_T9 (SEQ ID NO: 29) | 1285 | 1456 |
| HUMSMCK_T11 (SEQ ID NO: 30) | 1285 | 1456 |

Segment cluster HUMSMCK_node_12 (SEQ ID NO:152) according to the present invention is supported by 54 libraries. The number of libraries was determined as previously described. This segment can be found in the following transcript(s): HUMSMCK_T5 (SEQ ID NO:26), HUMSMCK_T6 (SEQ ID NO:27), HUMSMCK_T7 (SEQ ID NO:28), HUMSMCK_T9 (SEQ ID NO:29) and HUMSMCK_T11 (SEQ ID NO:30). Table 20 below describes the starting and ending position of this segment on each transcript.

TABLE 20

Segment location on transcripts

| Transcript name | Segment starting position | Segment ending position |
|---|---|---|
| HUMSMCK_T5 (SEQ ID NO: 26) | 1476 | 1655 |
| HUMSMCK_T6 (SEQ ID NO: 27) | 1476 | 1655 |
| HUMSMCK_T7 (SEQ ID NO: 28) | 1476 | 1655 |
| HUMSMCK_T9 (SEQ ID NO: 29) | 1476 | 1655 |
| HUMSMCK_T11 (SEQ ID NO: 30) | 1476 | 1655 |

Segment cluster HUMSMCK_node_17 (SEQ ID NO:153) according to the present invention is supported by 48 libraries. The number of libraries was determined as previously described. This segment can be found in the following transcript(s): HUMSMCK_T5 (SEQ ID NO:26), HUMSMCK_T6 (SEQ ID NO:27), HUMSMCK_T7 (SEQ ID NO:28), HUMSMCK_T9 (SEQ ID NO:29) and HUMSMCK_T111 (SEQ ID NO:30). Table 21 below describes the starting and ending position of this segment on each transcript.

TABLE 21

Segment location on transcripts

| Transcript name | Segment starting position | Segment ending position |
|---|---|---|
| HUMSMCK_T5 (SEQ ID NO: 26) | 1752 | 1973 |
| HUMSMCK_T6 (SEQ ID NO: 27) | 1752 | 1973 |
| HUMSMCK_T7 (SEQ ID NO: 28) | 1752 | 1973 |
| HUMSMCK_T9 (SEQ ID NO: 29) | 1752 | 1973 |
| HUMSMCK_T11 (SEQ ID NO: 30) | 1752 | 1973 |

Segment cluster HUMSMCK_node_22 (SEQ ID NO:154) according to the present invention is supported by 60 libraries. The number of libraries was determined as previously described. This segment can be found in the following transcript(s): HUMSMCK_T5 (SEQ ID NO:26), HUMSMCK_T6 (SEQ ID NO:27), HUMSMCK_T7 (SEQ ID NO:28), HUMSMCK_T9 (SEQ ID NO:29) and HUMSMCK_T111 (SEQ ID NO:30). Table 22 below describes the starting and ending position of this segment on each transcript.

TABLE 22

Segment location on transcripts

| Transcript name | Segment starting position | Segment ending position |
|---|---|---|
| HUMSMCK_T5 (SEQ ID NO: 26) | 2060 | 2183 |
| HUMSMCK_T6 (SEQ ID NO: 27) | 2060 | 2183 |
| HUMSMCK_T7 (SEQ ID NO: 28) | 1974 | 2097 |
| HUMSMCK_T9 (SEQ ID NO: 29) | 2060 | 2183 |
| HUMSMCK_T11 (SEQ ID NO: 30) | 1974 | 2097 |

Segment cluster HUMSMCK_node_23 (SEQ ID NO:155) according to the present invention is supported by 3 libraries. The number of libraries was determined as previously described. This segment can be found in the following transcript(s): HUMSMCK_T9 (SEQ ID NO:29) and HUMSMCK_T11(SEQ ID NO:30). Table 23 below describes the starting and ending position of this segment on each transcript.

TABLE 23

Segment location on transcripts

| Transcript name | Segment starting position | Segment ending position |
|---|---|---|
| HUMSMCK_T9 (SEQ ID NO: 29) | 2184 | 2382 |
| HUMSMCK_T11 (SEQ ID NO: 30) | 2098 | 2296 |

Segment cluster HUMSMCK_node_25 (SEQ ID NO:156) according to the present invention is supported by 58 libraries. The number of libraries was determined as previously described. This segment can be found in the following transcript(s): HUMSMCK_T5 (SEQ ID NO:26), HUMSMCK_T6 (SEQ ID NO:27) and HUMSMCK_T7 (SEQ ID NO:28). Table 24 below describes the starting and ending position of this segment on each transcript.

TABLE 24

Segment location on transcripts

| Transcript name | Segment starting position | Segment ending position |
|---|---|---|
| HUMSMCK_T5 (SEQ ID NO: 26) | 2184 | 2318 |
| HUMSMCK_T6 (SEQ ID NO: 27) | 2184 | 2318 |
| HUMSMCK_T7 (SEQ ID NO: 28) | 2098 | 2232 |

Segment cluster HUMSMCK_node_26 (SEQ ID NO:157) according to the present invention is supported by 1 libraries. The number of libraries was determined as previously described. This segment can be found in the following transcript(s): HUMSMCK_T6 (SEQ ID NO:27). Table 25 below describes the starting and ending position of this segment on each transcript.

TABLE 25

Segment location on transcripts

| Transcript name | Segment starting position | Segment ending position |
|---|---|---|
| HUMSMCK_T6 (SEQ ID NO: 27) | 2319 | 2448 |

Segment cluster HUMSMCK_node_28 (SEQ ID NO:158) according to the present invention is supported by 59 libraries. The number of libraries was determined as previously described. This segment can be found in the following transcript(s): HUMSMCK_T5 (SEQ ID NO:26) and HUMSMCK_T7 (SEQ ID NO:28). Table 26 below describes the starting and ending position of this segment on each transcript.

TABLE 26

Segment location on transcripts

| Transcript name | Segment starting position | Segment ending position |
|---|---|---|
| HUMSMCK_T5 (SEQ ID NO: 26) | 2319 | 2444 |
| HUMSMCK_T7 (SEQ ID NO: 28) | 2233 | 2358 |

Segment cluster HUMSMCK_node_29 (SEQ ID NO:159) according to the present invention is supported by 3 libraries. The number of libraries was determined as previously described. This segment can be found in the following transcript(s): HUMSMCK_T5 (SEQ ID NO:26). Table 27 below describes the starting and ending position of this segment on each transcript.

TABLE 27

Segment location on transcripts

| Transcript name | Segment starting position | Segment ending position |
|---|---|---|
| HUMSMCK_T5 (SEQ ID NO: 26) | 2445 | 2820 |

Segment cluster HUMSMCK_node_32 (SEQ ID NO:160) according to the present invention is supported by 62 libraries. The number of libraries was determined as previously described. This segment can be found in the following transcript(s): HUMSMCK_T7 (SEQ ID NO:28). Table 28 below describes the starting and ending position of this segment on each transcript.

TABLE 28

Segment location on transcripts

| Transcript name | Segment starting position | Segment ending position |
|---|---|---|
| HUMSMCK_T7 (SEQ ID NO: 28) | 2359 | 2632 |

According to an optional embodiment of the present invention, short segments related to the above cluster are also provided. These segments are up to about 120 bp in length, and so are included in a separate description.

Segment cluster HUMSMCK_node_11 (SEQ ID NO:161) according to the present invention can be found in the following transcript(s): HUMSMCK_T5 (SEQ ID NO:26), HUMSMCK_T6 (SEQ ID NO:27), HUMSMCK_T7 (SEQ ID NO:28), HUMSMCK_T9 (SEQ ID NO:29) and HUMSMCK_T11 (SEQ ID NO:30). Table 29 below describes the starting and ending position of this segment on each transcript.

TABLE 29

Segment location on transcripts

| Transcript name | Segment starting position | Segment ending position |
|---|---|---|
| HUMSMCK_T5 (SEQ ID NO: 26) | 1457 | 1475 |
| HUMSMCK_T6 (SEQ ID NO: 27) | 1457 | 1475 |
| HUMSMCK_T7 (SEQ ID NO: 28) | 1457 | 1475 |
| HUMSMCK_T9 (SEQ ID NO: 29) | 1457 | 1475 |
| HUMSMCK_T11 (SEQ ID NO: 30) | 1457 | 1475 |

Segment cluster HUMSMCK_node_14 (SEQ ID NO:162) according to the present invention is supported by 38 libraries. The number of libraries was determined as previously described. This segment can be found in the following transcript(s): HUMSMCK_T5 (SEQ ID NO:26), HUMSMCK_T6 (SEQ ID NO:27), HUMSMCK_T7 (SEQ ID NO:28), HUMSMCK_T9 (SEQ ID NO:29) and HUMSMCK_T11 (SEQ ID NO:30). Table 30 below describes the starting and ending position of this segment on each transcript.

TABLE 30

Segment location on transcripts

| Transcript name | Segment starting position | Segment ending position |
|---|---|---|
| HUMSMCK_T5 (SEQ ID NO: 26) | 1656 | 1751 |
| HUMSMCK_T6 (SEQ ID NO: 27) | 1656 | 1751 |
| HUMSMCK_T7 (SEQ ID NO: 28) | 1656 | 1751 |
| HUMSMCK_T9 (SEQ ID NO: 29) | 1656 | 1751 |
| HUMSMCK_T11 (SEQ ID NO: 30) | 1656 | 1751 |

Segment cluster HUMSMCK_node$_{13}$ 19 (SEQ ID NO:163) according to the present invention is supported by 47 libraries. The number of libraries was determined as previously described. This segment can be found in the following transcript(s): HUMSMCK_T5 (SEQ ID NO:26), HUMSMCK_T6 (SEQ ID NO:27) and HUMSMCK_T9 (SEQ ID NO:29). Table 31 below describes the starting and ending position of this segment on each transcript.

TABLE 31

Segment location on transcripts

| Transcript name | Segment starting position | Segment ending position |
|---|---|---|
| HUMSMCK_T5 (SEQ ID NO: 26) | 1974 | 2059 |
| HUMSMCK_T6 (SEQ ID NO: 27) | 1974 | 2059 |
| HUMSMCK_T9 (SEQ ID NO: 29) | 1974 | 2059 |

Variant Protein Alignment to the Previously Known Protein:
Sequence name: KCRS_HUMAN_V1 (SEQ ID NO:347)
Sequence documentation:
Alignment of: HUMSMCK_P4 (SEQ ID NO:305) ×KCRS_HUMAN_V1 (SEQ ID NO:347)

Alignment segment 1/1:

| | | | |
|---|---|---|---|
| Quality: | 3745.00 | Escore: | 0 |
| Matching length: | 381 | Total length: | 381 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Sequence mane: KCRS_HUMAN_V1 (SEQ ID NO:347)

Sequence documentation:

Alignment of: HUMSMCK_P5 (SEQ ID NO:306) ×KCRS_HUMAN_V1 (SEQ ID NO:347)

Alignment segment 1/1:

| | | | |
|---|---|---|---|
| Quality: | 3344.00 | Escore: | 0 |
| Matching length: | 338 | Total length: | 338 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MASIFSKLLTGRNASLLFATMGTSVLTTGYLLNRQKVCAEVREQPRLFPPP   50
     ||||||||||||||||||||||||||||||||||||||||||||||||||
  1  MASIFSKLLTGRNASLLFATMGTSVLTTGYLLNRQKVCAEVREQPRLFPPP   50

51  SADYPDLRKHNNCMAECLTPAIYAKLRNKVTPNGYTLDQCIQTGVDNPGH   100
     ||||||||||||||||||||||||||||||||||||||||||||||||||
 51  SADYPDLRKHNNCMAECLTPAIYAKLRNKVTPNGYTLDQCIQTGVDNPGH   100

101  PFIKTVGMVAGDEESYEVFADLFDPVIKLRHNGYDPRVMKHTTDLDASKI   150
     ||||||||||||||||||||||||||||||||||||||||||||||||||
101  PFIKTVGMVAGDEESYEVFADLFDPVIKLRHNGYDPRVMKHTTDLDASKI   150

151  TQGQFDEHYVLSSRVRTGRSIRGLSLPPACTRAERREVENVAITALEGLK   200
     ||||||||||||||||||||||||||||||||||||||||||||||||||
151  TQGQFDEHYVLSSRVRTGRSIRGLSLPPACTRAERREVENVAITALEGLK   200

201  GDLAGRYYKLSEMTEQDQQRLIDDHFLFDKPVSPLLTCAGMARDWPDARG   250
     ||||||||||||||||||||||||||||||||||||||||||||||||||
201  GDLAGRYYKLSEMTEQDQQRLIDDHFLFDKPVSPLLTCAGMARDWPDARG   250

251  IWHNYDKTFLIWINEEDHTRVISMEKGGNMKRVFERFCRGLKEVERLIQE   300
     ||||||||||||||||||||||||||||||||||||||||||||||||||
251  IWHNYDKTFLIWINEEDHTRVISMEKGGNMKRVFERFCRGLKEVERLIQE   300

301  RGWEFMWNERLGYILTCPSNLGTGLRAGVHVRIPKLSKDPRFSKILENLR   350
     ||||||||||||||||||||||||||||||||||||||||||||||||||
301  RGWEFMWNERLGYILTCPSNLGTGLRAGVHVRIPKLSKDPRFSKILENLR   350

351  LQKRGTGGVDTAAVADVYDISNIDRIGRSEV                     381
     |||||||||||||||||||||||||||||||
351  LQKRGTGGVDTAAVADVYDISNIDRIGRSEV                     381
```

Alignment

```
  1  MASIFSKLLTGRNASLLFATMGTSVLTTGYLLNRQKVCAEVREQPRLFPP   50
     ||||||||||||||||||||||||||||||||||||||||||||||||||
  1  MASIFSKLLTGRNASLLFATMGTSVLTTGYLLNRQKVCAEVREQPRLFPP   50

51  SADYPDLRKHNNCMAECLTPAIYAKLRNKVTPNGYTLDQCIQTGVDNPGH  100
     ||||||||||||||||||||||||||||||||||||||||||||||||||
 51  SADYPDLRKHNNCMAECLTPAIYAKLRNKVTPNGYTLDQCIQTGVDNPGH  100

101  PFIKTVGMVAGDEESYEVFADLFDPVIKLRHNGYDPRVMKHTTDLDASKI  150
     ||||||||||||||||||||||||||||||||||||||||||||||||||
101  PFIKTVGMVAGDEESYEVFADLFDPVIKLRHNGYDPRVMKHTTDLDASKI  150

151  TQGQFDEHYVLSSRVRTGRSIRGLSLPPACTRAERREVENVAITALEGLK  200
     ||||||||||||||||||||||||||||||||||||||||||||||||||
151  TQGQFDEHYVLSSRVRTGRSIRGLSLPPACTRAERREVENVAITALEGLK  200

201  GDLAGRYYKLSEMTEQDQQRLIDDHFLFDKPVSPLLTCAGMARDWPDARG  250
     ||||||||||||||||||||||||||||||||||||||||||||||||||
201  GDLAGRYYKLSEMTEQDQQRLIDDHFLFDKPVSPLLTCAGMARDWPDARG  250

251  IWHNYDKTFLIWINEEDHTRVISMEKGGNMKRVFERFCRGLKEVERLIQE  300
     ||||||||||||||||||||||||||||||||||||||||||||||||||
251  IWHNYDKTFLIWINEEDHTRVISMEKGGNMKRVFERFCRGLKEVERLIQE  300

301  RGWEFMWNERLGYILTCPSNLGTGLRAGVHVRIPKLSK              338
     |||||||||||||||||||||||||||||||||||||
301  RGWEFMWNERLGYILTCPSNLGTGLRAGVHVRIPKLSK              338
```

Sequence name: KCRS_HUMAN _V1 (SEQ ID NO:347)
Sequence documentation:
Alignment of: HUMSMCK_P6 (SEQ ID NO:307) ×KCRS_HUMAN_V1 (SEQ ID NO:347)

| Alignment segment 1/1: | | | |
|---|---|---|---|
| Quality: | 2176.00 | Escore: | 0 |
| Matching length: | 223 | Total length: | 223 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment

Sequence name: KCRS_HUMAN _V1 (SEQ ID NO:347)
Sequence documentation:
Alignment of: HUMSMCK_P8 (SEQ ID NO:308) ×KCRS_HUMAN_V1 (SEQ ID NO:347)

| Alignment segment 1/1: | | | |
|---|---|---|---|
| Quality: | 2904.00 | Escore: | 0 |
| Matching length: | 294 | Total length: | 294 |
| Matching Percent Similarity: | 100.00 | Matching Percent Identity: | 100.00 |
| Total Percent Similarity: | 100.00 | Total Percent Identity: | 100.00 |
| Gaps: | 0 | | |

```
  1  MASIFSKLLTGRNASLLFATMGTSVLTTGYLLNRQKVCAEVREQPRLFPP   50
     ||||||||||||||||||||||||||||||||||||||||||||||||||
  1  MASIFSKLLTGRNASLLFATMGTSVLTTGYLLNRQKVCAEVREQPRLFPP   50

51  SADYPDLRKHNNCMAECLTPAIYAKLRNKVTPNGYTLDQCIQTGVDNPGH  100
     ||||||||||||||||||||||||||||||||||||||||||||||||||
 51  SADYPDLRKHNNCMAECLTPAIYAKLRNKVTPNGYTLDQCIQTGVDNPGH  100

101  PFIKTVGMVAGDEESYEVFADLFDPVIKLRHNGYDPRVMKHTTDLDASKI  150
     ||||| ||||||||||||||||||||||||||||||||||||||||||||
101  PFIKYVGMVAGDEESYEVFADLFDPVIKLRHNGYDPRVMKHTTDLDASKI  150

151  TQGQFDEHYVLSSRVRTGRSIRGLSLPPACTRAERREVENVAITALEGLK  200
     ||||||||||||||||||||||||||||||||||||||||||||||||||
151  TQGQFDEHYVLSSRVRTGRSIRGLSLPPACTRAERREVENVAITALEGLK  200

201  GDLAGRYYKLSEMTEQDQQRLID                              223
     |||||||||||||||||||||||
201  GDLAGRYYKLSEMTEQDQQRLID                              223
```

Alignment

```
  1 MASIFSKLLTGRNASLLFATMGTSVLTTGYLLNRQKVCAEVREQPRLFPP   50
    ||||||||||||||||||||||||||||||||||||||||||||||||||
  1 MASIFSKLLTGRNASLLFATMGTSVLTTGYLLNRQKVCAEVREQPRLFPP   50

51 SADYPDLRKHNNCMAECLTPAIYAKLRNKVTPNGYTLDQCIQTGVDNPGH  100
    ||||||||||||||||||||||||||||||||||||||||||||||||||
 51 SADYPDLRKHNNCMAECLTPAIYAKLRNKVTPNGYTLDQCIQTGVDNPGH  100

101 PFIKTVGMVAGDEESYEVFADLFDPVIKLRHNGYDPRVMKHTTDLDASKI  150
    ||||||||||||||||||||||||||||||||||||||||||||||||||
101 PFIKTVGMVAGDEESYEVFADLFDPVIKLRHNGYDPRVMKHTTDLDASKI  150

151 TQGQFDEHYVLSSRVRTGRSIRGLSLPPACTRAERREVENVAITALEGLK  200
    ||||||||||||||||||||||||||||||||||||||||||||||||||
151 TQGQFDEHYVLSSRVRTGRSIRGLSLPPACTRAERREVENVAITALEGLK  200

201 GDLAGRYYKLSEMTEQDQQRLIDDHFLFDKPVSPLLTCAGMARDWPDARG  250
    ||||||||||||||||||||||||||||||||||||||||||||||||||
201 GDLAGRYYKLSEMTEQDQQRLIDDHFLFDKPVSPLLTCAGMARDWPDARG  250

251 IWHNYDKTFLIWINEEDHTRVISMEKGGNMKRVFERFCRGLKEV        294
    |||||||||||||||||||||||||||||||||||||||||||
251 IWHNYDKTFLIWINEEDHTRVISMEKGGNMKRVFERFCRGLKEV        294
```

Description for Cluster H88495

Cluster H88495 features 7 transcript(s) and 22 segment(s) of interest, the names for which are given in Tables 1 and 2, respectively, the sequences themselves are given at the end of the application. The selected protein variants are given in table 3.

TABLE 1

Transcripts of interest

| Transcript Name | Seq ID No. |
| --- | --- |
| H88495_PEA_3_T3 | 31 |
| H88495_PEA_3_T4 | 32 |
| H88495_PEA_3_T5 | 33 |
| H88495_PEA_3_T6 | 34 |
| H88495_PEA_3_T7 | 35 |
| H88495_PEA_3_T8 | 36 |
| H88495_PEA_3_T9 | 37 |

TABLE 2

Segments of interest

| Segment Name | Seq ID No. |
| --- | --- |
| H88495_PEA_3_node_0 | 164 |
| H88495_PEA_3_node_1 | 165 |
| H88495_PEA_3_node_4 | 166 |
| H88495_PEA_3_node_9 | 167 |
| H88495_PEA_3_node_13 | 168 |
| H88495_PEA_3_node_19 | 169 |
| H88495_PEA_3_node_21 | 170 |
| H88495_PEA_3_node_26 | 171 |
| H88495_PEA_3_node_2 | 172 |
| H88495_PEA_3_node_5 | 173 |
| H88495_PEA_3_node_6 | 174 |
| H88495_PEA_3_node_7 | 175 |
| H88495_PEA_3_node_8 | 176 |
| H88495_PEA_3_node_10 | 177 |
| H88495_PEA_3_node_11 | 178 |
| H88495_PEA_3_node_12 | 179 |
| H88495_PEA_3_node_14 | 180 |
| H88495_PEA_3_node_16 | 181 |
| H88495_PEA_3_node_18 | 182 |

TABLE 2-continued

Segments of interest

| Segment Name | Seq ID No. |
| --- | --- |
| H88495_PEA_3_node_20 | 183 |
| H88495_PEA_3_node_23 | 184 |
| H88495_PEA_3_node_24 | 185 |

TABLE 3

Proteins of interest

| Protein Name | Seq ID No. | Corresponding Transcript(s) |
| --- | --- | --- |
| H88495_PEA_3_P15 | 309 | H88495_PEA_3_T3 (SEQ ID NO: 31); H88495_PEA_3_T4 (SEQ ID NO: 32); H88495_PEA_3_T7 (SEQ ID NO: 35) |
| H88495_PEA_3_P16 | 310 | H88495_PEA_3_T5 (SEQ ID NO: 33); H88495_PEA_3_T6 (SEQ ID NO: 34) |
| H88495_PEA_3_P17 | 311 | H88495_PEA_3_T8 (SEQ ID NO: 36) |
| H88495_PEA_3_P18 | 312 | H88495_PEA_3_T9 (SEQ ID NO: 37) |

These sequences are variants of the known protein Sarcoplasmic reticulum histidine-rich calcium-binding protein precursor (SEQ ID NO:389) (SwissProt accession identifier SRCH_HUMAN), referred to herein as the previously known protein.

Protein Sarcoplasmic reticulum histidine-rich calcium-binding protein precursor (SEQ ID NO:389) is known or believed to have the following function(s): May play a role in the regulation of calcium sequestration or release in the SR of skeletal and cardiac muscle. The sequence for protein Sarcoplasmic reticulum histidine-rich calcium-binding protein precursor is given at the end of the application, as "Sarcoplasmic reticulum histidine-rich calcium-binding protein precursor amino acid sequence" (SEQ ID NO:389). Known polymorphisms for this sequence are as shown in Table 4.

TABLE 4

Amino acid mutations for Known Protein

| SNP position(s) on amino acid sequence | Comment |
|---|---|
| 96 | S -> A. /FTId=VAR_005623. |
| 204 | Missing. /FTId=VAR_011622. |

Protein Sarcoplasmic reticulum histidine-rich calcium-binding protein precursor (SEQ ID NO:389) localization is believed to be Sarcoplasmic reticulum lumen.

The following GO Annotation(s) apply to the previously known protein. The following annotation(s) were found: muscle contraction, which are annotation(s) related to Biological Process; and calcium binding, which are annotation(s) related to Molecular Function.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

The heart-selective diagnostic marker prediction engine provided the following results with regard to cluster H88495. Predictions were made for selective expression of transcripts of this cluster in heart tissue, according to the previously described methods. The numbers on the y-axis of FIG. 25 refer to weighted expression of ESTs in each category, as "parts per million" (ratio of the expression of ESTs for a particular cluster to the expression of all ESTs in that category, according to parts per million).

Figure 25:
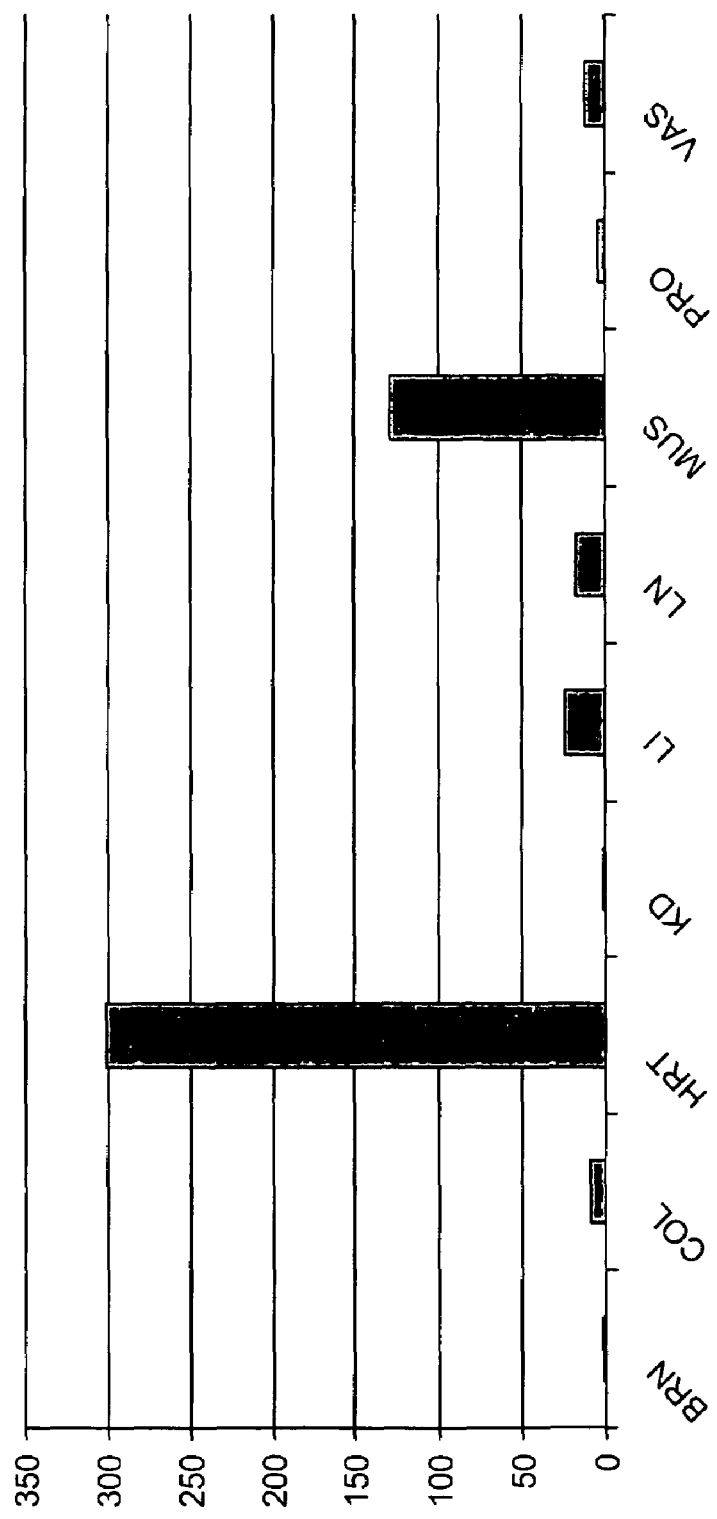
FIG. 25 is a histogram showing ESTs concerning the number of heart tissue-specific clones in libraries/sequences
Figure 26:
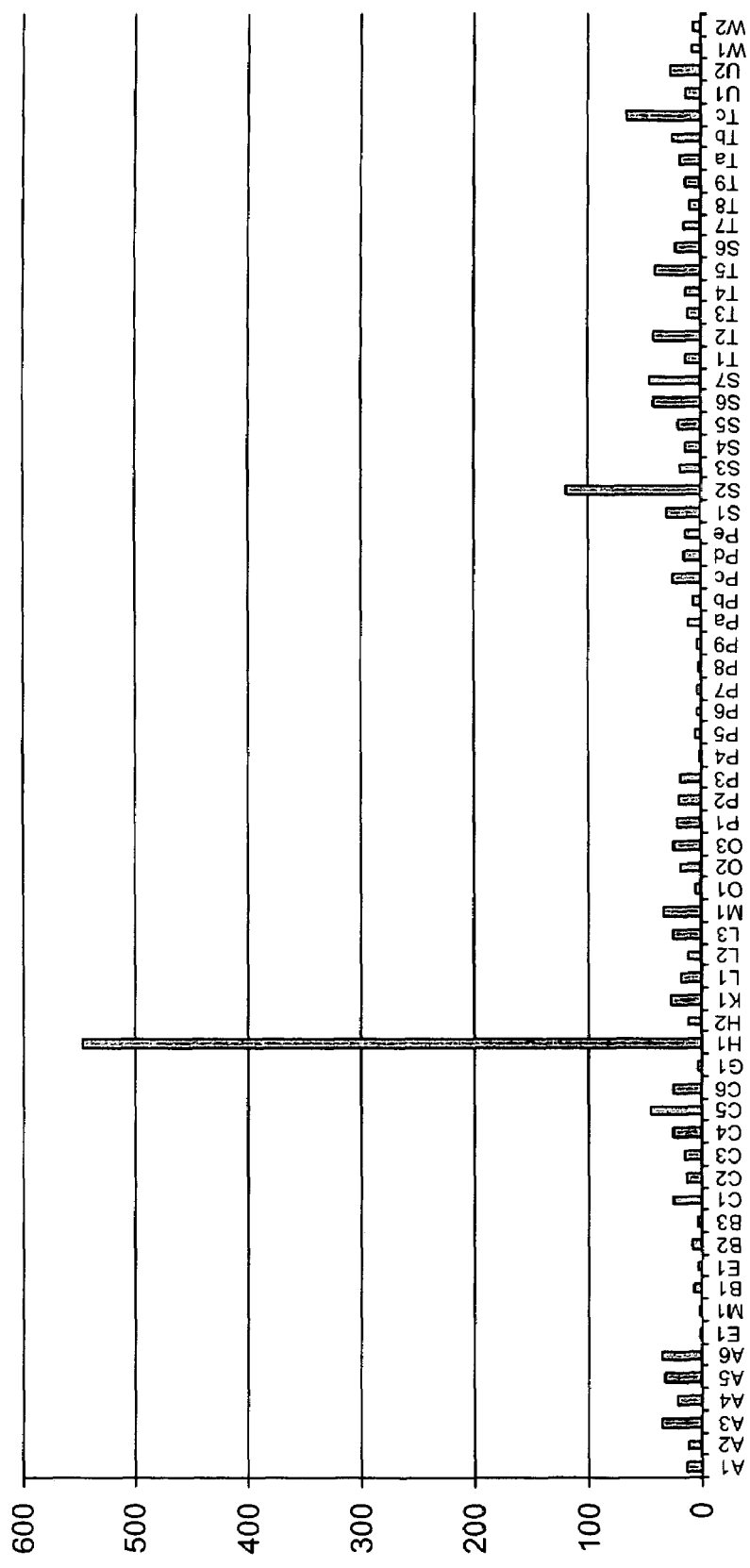
FIG. 26 is a histogram concerning the actual expression of oligonucleotides in various tissues, prob 207066_at (SEQ ID NO:392), including heart tissue.

Overall, the following results were obtained as shown with regard to the histogram in FIG. 25, concerning the number of heart-specific clones in libraries/sequences; as well as with regard to the histogram in FIG. 26, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 13.7; the ratio of expression of the cluster in heart specific ESTs to the overall expression of the cluster in muscle-specific ESTs which was found to be 2.3; and fisher exact test P-values were computed both for library and weighted clone counts to check that the counts are statistically significant, and were found to be 1.90E-06.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 13.7, which clearly supports specific expression in heart tissue.

As noted above, cluster H88495 features 7 transcript(s), which were listed in Table 1 above. These transcript(s) encode for protein(s) which are variant(s) of protein Sarcoplasmic reticulum histidine-rich calcium-binding protein precursor (SEQ ID NO:389). A description of each variant protein according to the present invention is now provided.

Variant protein H88495_PEA_3_P15 (SEQ ID NO:309) according to the present invention has an amino acid sequence as given at the end of the application; it is encoded by transcript(s) H88495_PEA_3_T3 (SEQ ID NO:31), H88495_PEA_3_T4 (SEQ ID NO:32) and H88495_PEA_3_T7 (SEQ ID NO:35). An alignment is given to the known protein (Sarcoplasmic reticulum histidine-rich calcium-binding protein precursor (SEQ ID NO:389)) at the end of the application. One or more alignments to one or more previously published protein sequences are given at the end of the application. A brief description of the relationship of the variant protein according to the present invention to each such aligned protein is as follows:

Comparison report between H88495_PEA_3_P15 (SEQ ID NO:309) and SRCH_HUMAN_V1 (SEQ ID NO:346):

1. An isolated chimeric polypeptide encoding for H88495_PEA_3_P 15 (SEQ ID NO:309), comprising a first amino acid sequence being at least 90% homologous to MGHHRPWLHASVLWAGVASLLLPPAM-TQQLRGDGLGFRNRNN corresponding to amino acids 1-42 of SRCH_HUMAN_V1 (SEQ ID NO:346), which also corresponds to amino acids 1-42 of H88495_PEA_3$_{13}$ P 15 (SEQ ID NO:309), a bridging amino acid N corresponding to amino acid 43 of H88495_PEA_3_P15 (SEQ ID NO:309), a second amino acid sequence being at least 90% homologous to TGVAGLSEEASAELRHHLHSPRDHP-DENKDVSTENGHHFWSHPDREKEDEDVAKEYG HLLPGHRSQDHKVGDEGVSGEEVFAEHG-GQARGHRGHGSEDTEDSAEHRHHLPSHRS HSHQD-EDEDEVVSSEHHHHILRHGHRGHDGED-DEGEEEEEEEEEEEEASTEYGHQAHR HRGHGSEEDEDVSDGHHHHGP-SHRHQGHEED-DDDDDDDDDDDDDDDDVSIEYRHQAH RHQGH-GIEEDEDVSDGHHHRDPSHRHRSHEEDDNDDDDVS TEYGHQAHRHQDHRKEE VEAVSGEHHHHVP-DHRHQGHRDEEEDEDVSTERWHQGPQH-VHHGLVDEEEEEEEITV QFGHYVASHQPRGHKS-DEEDFQDEYKTEVPHHHHHRVPREEDEEVSAELGH QAPSHR QSHQDEETGHGQRGSIKEMSHHPPGHTV-VKDRSHLRKDDSEEEKEKEEDPGSHEEDDE SSE-QGEKGTHHGSRDQEDEEDEEEGHGLSLN-QEEEEEEDKEEEEEEEDEERREERAEVG APLSPDHSEEEEEEEEGLEEDEPRFTI-IPNPLDRREEAGGASSEEESGEDTGPQDAQEYGN YQPGSLCGYCSFCNRCTECESCHCDEEN-MGEHCDQCQ corresponding to amino acids 44-657 of SRCH_HUMAN_V1 (SEQ ID NO:346), which also corresponds to amino acids 44-657 of H88495_PEA_3_P15 (SEQ ID NO:309), and a third amino acid sequence being at least 70%, optionally at least 80%, preferably at least 85%, more preferably at least 90% and most preferably at least 95% homologous to a polypeptide having the sequence VRPHLTLKAPLGLRMHRDPLRTPSPKSW-PLTQPLTPDATLTPQAILTPTLT (SEQ ID NO:418) corresponding to amino acids 658-708 of H88495_PEA_3_P15 (SEQ ID NO:309), wherein said first amino acid sequence, bridging amino acid, second amino acid sequence and third amino acid sequence are contiguous and in a sequential order.

2. An isolated polypeptide encoding for a tail of H88495_PEA_3_P15 (SEQ ID NO:309), comprising a polypeptide being at least 70%, optionally at least about 80%, preferably at least about 85%, more preferably at least about 90% and most preferably at least about 95% homologous to the sequence VRPHLTLKAPLGLRMHRDPL- RTPSPKSWPLTQPLTPDATLTPQAILTPTLT (SEQ ID NO:418) in H88495_PEA_3_P 15 (SEQ ID NO:309).

It should be noted that the known protein sequence (SRCH_HUMAN; SEQ ID NO:389) has one or more changes than the sequence given at the end of the application and named as being the amino acid sequence for SRCH_HUMAN_V1 (SEQ ID NO:346). These changes were previously known to occur and are listed in the table below.

TABLE 5

Changes to SRCH_HUMAN_V1 (SEQ ID NO: 346)

| SNP position(s) on amino acid sequence | Type of change |
|---|---|
| 97 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H88495_PEA_3_P15 (SEQ ID NO:309) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein H88495_PEA_3_P15 (SEQ ID NO:309) sequence provides support for the deduced sequence of this variant protein according to the present invention).

TABLE 6

Amino acid mutations

| SNP position(s) on amino acid sequence | Alternative amino acid(s) | Previously known SNP? |
|---|---|---|
| 6 | P -> L | No |
| 6 | P -> S | No |
| 43 | N -> S | Yes |
| 96 | A -> S | Yes |
| 364 | Q -> | No |
| 580 | D -> H | Yes |

Variant protein H88495_PEA_3_P15 (SEQ ID NO:309) is encoded by the following transcript(s): H88495_PEA_3_T3 (SEQ ID NO:31), H88495_PEA_3_T4 (SEQ ID NO:32) and H88495_PEA_3_T7 (SEQ ID NO:35), for which the sequence(s) is/are given at the end of the application.

The coding portion of transcript H88495_PEA_3_T3 (SEQ ID NO:31) is shown in bold; this coding portion starts at position 743 and ends at position 2866. The transcript also has the following SNPs as listed in Table 7 (given according to their position on the nucleotide sequence, with the alternative nucleic acid listed; the last column indicates whether the SNP is known or not; the presence of known SNPs in variant protein H88495_PEA_3P15 (SEQ ID NO:309) sequence provides support for the deduced sequence of this variant protein according to the present invention).

TABLE 7

Nucleic acid SNPs

| SNP position on nucleotide sequence | Alternative nucleic acid | Previously known SNP? |
|---|---|---|
| 223 | A -> G | Yes |
| 285 | C -> T | Yes |
| 362 | A -> C | Yes |
| 373 | G -> C | Yes |
| 628 | A -> T | No |
| 629 | G -> T | No |
| 758 | C -> T | No |
| 759 | C -> T | No |
| 847 | G -> A | Yes |
| 870 | A -> G | Yes |
| 958 | G -> A | No |
| 1028 | G -> T | Yes |
| 1321 | A -> G | Yes |
| 1834 | G -> | No |
| 1903 | C -> T | Yes |
| 2480 | G -> C | Yes |

The coding portion of transcript H88495_PEA_3_T4 (SEQ ID NO:32) is shown in bold; this coding portion starts at position 743 and ends at position 2866. The transcript also has the following SNPs as listed in Table 8 (given according to their position on the nucleotide sequence, with the alternative nucleic acid listed; the last column indicates whether the SNP is known or not; the presence of known SNPs in variant protein H88495_PEA_3_P15 (SEQ ID NO:309) sequence provides support for the deduced sequence of this variant protein according to the present invention).

TABLE 8

Nucleic acid SNPs

| SNP position on nucleotide sequence | Alternative nucleic acid | Previously known SNP? |
|---|---|---|
| 223 | A -> G | Yes |
| 285 | C -> T | Yes |
| 362 | A -> C | Yes |
| 373 | G -> C | Yes |
| 628 | A -> T | No |
| 629 | G -> T | No |
| 758 | C -> T | No |
| 759 | C -> T | No |
| 847 | G -> A | Yes |
| 870 | A -> G | Yes |
| 958 | G -> A | No |
| 1028 | G -> T | Yes |
| 1321 | A -> G | Yes |
| 1834 | G -> | No |
| 1903 | C -> T | Yes |
| 2480 | G -> C | Yes |
| 3225 | G -> A | Yes |

The coding portion of transcript H88495_PEA$_{13}$ 3_T7 (SEQ ID NO:35) is shown in bold; this coding portion starts at position 743 and ends at position 2866. The transcript also has the following SNPs as listed in Table 9 (given according to their position on the nucleotide sequence, with the alternative nucleic acid listed; the last column indicates whether the SNP is known or not; the presence of known SNPs in variant protein H88495_PEA_3_P15 (SEQ ID NO:309) sequence provides support for the deduced sequence of this variant protein according to the present invention).

TABLE 9

Nucleic acid SNPs

| SNP position on nucleotide sequence | Alternative nucleic acid | Previously known SNP? |
| --- | --- | --- |
| 223 | A -> G | Yes |
| 285 | C -> T | Yes |
| 362 | A -> C | Yes |
| 373 | G -> C | Yes |
| 628 | A -> T | No |
| 629 | G -> T | No |
| 758 | C -> T | No |
| 759 | C -> T | No |
| 847 | G -> A | Yes |
| 870 | A -> G | Yes |
| 958 | G -> A | No |
| 1028 | G -> T | Yes |
| 1321 | A -> G | Yes |
| 1834 | G -> | No |
| 1903 | C -> T | Yes |
| 2480 | G -> C | Yes |
| 3106 | T -> A | Yes |

Variant protein H88495_PEA_3_P16 (SEQ ID NO:310) according to the present invention has an amino acid sequence as given at the end of the application; it is encoded by transcript(s) H88495_PEA_3_T5 (SEQ ID NO:33) and H88495_PEA_3_T6 (SEQ ID NO:34). An alignment is given to the known protein (Sarcoplasmic reticulum histidine-rich calcium-binding protein precursor (SEQ ID NO:389)) at the end of the application. One or more alignments to one or more previously published protein sequences are given at the end of the application. A brief description of the relationship of the variant protein according to the present invention to each such aligned protein is as follows:

Comparison report between H88495_PEA_3_P16 (SEQ ID NO:310) and SRCH_HUMAN_V1 (SEQ ID NO:346):

1. An isolated chimeric polypeptide encoding for H88495_PEA_3_P16 (SEQ ID NO:310), comprising a first amino acid sequence being at least 90% homologous to MGHHRPWLHASVLWAGVASLLLPPAM-TQQLRGDGLGFRNRNN corresponding to amino acids 1-42 of SRCH_HUMAN_V1 (SEQ ID NO:346), which also corresponds to amino acids 1-42 of H88495_PEA_3_P 16 (SEQ ID NO:310), a bridging amino acid N corresponding to amino acid 43 of H88495_PEA_3_P16 (SEQ ID NO:310), a second amino acid sequence being at least 90% homologous to TGVAGLSEEASAELRHHLHSPRDHP-DENKDVSTENGHHFWSHPDREKEDEDVAKEYG HLLPGHRSQDHKVGDEGVSGEEVFAEHG-GQARGHRGHGSEDTEDSAEHRHHLPSHRS HSHQD-EDEDEVVSSEHHHHILRHGHRGHDGED-DEGEEEEEEEEEEEEASTEYGHQAHR HRGHGSEEDEDVSDGHHHHGP-SHRHQGHEED-DDDDDDDDDDDDDDDVSIEYRHQAH RHQGH-GIEEDEDVSDGHHHRDPSHRHRSHEEDDNDDDDVS TEYGHQAHRHQDHRKEE VEAVSGEHHHHVP-DHRHQGHRDEEEDEDVSTERWHQGPQH-VHHGLVDEEEEEEEITV QFGHYVASHQPRGHKS-DEEDFQDEYKTEVPHHHHHRVPREEDEEVSAELGH QAPSHR QSHQDEETGHGQRGSIKEMSHHPPGHTV-VKDRSHLRKDDSEEEKEKEEDPGSHEEDDE SSE-QGEKGTHHGSRDQEDEEDEEEGHGLSLN-QEEEEEEDKEEEEEEEDEERREERAEVG APLSPDHSEEEEEEEEGLEEDEPRFTI-IPNPLDRREEAGGASSEEESGEDTGPQDAQEYGN YQPGSLCGYCSFCNRCTECESCHCDEEN-MGEHCDQCQHCQFCYLCPLVCETVCAPG corresponding to amino acids 44-676 of SRCH_HUMAN_V1 (SEQ ID NO:346), which also corresponds to amino acids 44-676 of H88495_PEA_3_P16 (SEQ ID NO:310), and a third amino acid sequence being at least 70%, optionally at least 80%, preferably at least 85%, more preferably at least 90% and most preferably at least 95% homologous to a polypeptide having the sequence EHGRGPGKT (SEQ ID NO:419) corresponding to amino acids 677-685 of H88495_PEA_3_P16 (SEQ ID NO:310), wherein said first amino acid sequence, bridging amino acid, second amino acid sequence and third amino acid sequence are contiguous and in a sequential order.

2. An isolated polypeptide encoding for a tail of H88495_PEA_3_P16 (SEQ ID NO:310), comprising a polypeptide being at least 70%, optionally at least about 80%, preferably at least about 85%, more preferably at least about 90% and most preferably at least about 95% homologous to the sequence EHGRGPGKT (SEQ ID NO:419) in H88495_PEA_3_P16 (SEQ ID NO:310).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein H88495_PEA_3_P16 (SEQ ID NO:310) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein H88495_PEA_3_P16 (SEQ ID NO:310) sequence provides support for the deduced sequence of this variant protein according to the present invention).

TABLE 11

Amino acid mutations

| SNP position(s) on amino acid sequence | Alternative amino acid(s) | Previously known SNP? |
| --- | --- | --- |
| 6 | P -> L | No |
| 6 | P -> S | No |
| 43 | N -> S | Yes |
| 96 | A -> S | Yes |
| 364 | Q -> | No |
| 580 | D -> H | Yes |

Variant protein H88495_PEA_3_P16 (SEQ ID NO:310) is encoded by the following transcript(s): H88495_PEA_3_T5 (SEQ ID NO:33) and H88495_PEA_3_T6 (SEQ ID NO:34), for which the sequence(s) is/are given at the end of the application.

The coding portion of transcript H88495_PEA_3_T5 (SEQ ID NO:33) is shown in bold; this coding portion starts at position 743 and ends at position 2797. The transcript also has the following SNPs as listed in Table 12 (given according to their position on the nucleotide sequence, with the alternative nucleic acid listed; the last column indicates whether the SNP is known or not; the presence of known SNPs in variant protein H88495_PEA_3_P16 (SEQ ID NO:310) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 223 | A -> G | Yes |
| 285 | C -> T | Yes |
| 362 | A -> C | Yes |
| 373 | G -> C | Yes |
| 628 | A -> T | No |
| 629 | G -> T | No |
| 758 | C -> T | No |
| 759 | C -> T | No |
| 847 | G -> A | Yes |
| 870 | A -> G | Yes |
| 958 | G -> A | No |
| 1028 | G -> T | Yes |
| 1321 | A -> G | Yes |
| 1834 | G -> | No |
| 1903 | C -> T | Yes |
| 2480 | G -> C | Yes |
| 2855 | T -> A | Yes |

The coding portion of transcript H88495_PEA_3_T6 (SEQ ID NO:34) is shown in bold; this coding portion starts at position 743 and ends at position 2797. The transcript also has the following SNPs as listed in Table 13 (given according to their position on the nucleotide sequence, with the alternative nucleic acid listed; the last column indicates whether the SNP is known or not; the presence of known SNPs in variant protein H88495_PEA_3_P16 (SEQ ID NO:310) sequence provides support for the deduced sequence of this variant protein according to the present invention).

TABLE 13

Nucleic acid SNPs

| SNP position on nucleotide sequence | Alternative nucleic acid | Previously known SNP? |
|---|---|---|
| 223 | A -> G | Yes |
| 285 | C -> T | Yes |
| 362 | A -> C | Yes |
| 373 | G -> C | Yes |
| 628 | A -> T | No |
| 629 | G -> T | No |
| 758 | C -> T | No |
| 759 | C -> T | No |
| 847 | G -> A | Yes |
| 870 | A -> G | Yes |
| 958 | G -> A | No |
| 1028 | G -> T | Yes |
| 1321 | A -> G | Yes |
| 1834 | G -> | No |
| 1903 | C -> T | Yes |
| 2480 | G -> C | Yes |
| 2855 | T -> A | Yes |
| 3293 | G -> A | Yes |

Variant protein H88495_PEA_3_P17 (SEQ ID NO:311) according to the present invention has an amino acid sequence as given at the end of the application; it is encoded by transcript(s) H88495_PEA_3_T8 (SEQ ID NO:36). An alignment is given to the known protein (Sarcoplasmic reticulum histidine-rich calcium-binding protein precursor (SEQ ID NO:389)) at the end of the application. One or more alignments to one or more previously published protein sequences are given at the end of the application. A brief description of the relationship of the variant protein according to the present invention to each such aligned protein is as follows:

Comparison report between H88495_PEA_3_P17 (SEQ ID NO:311) and SRCH_HUMAN_V1 (SEQ ID NO:346):

1. An isolated chimeric polypeptide encoding for H88495_PEA_3_P17 (SEQ ID NO:311), comprising a first amino acid sequence being at least 90% homologous to MCHHRPWLHASVLWAGVASLLLPPAM-TQQLRGDGLGFRNRNN corresponding to amino acids 1-42 of SRCH_HUMAN_V1 (SEQ ID NO:346), which also corresponds to amino acids 1-42 of H88495_PEA_3_P17 (SEQ ID NO:311), a bridging amino acid N corresponding to amino acid 43 of H88495_PEA_3_P17 (SEQ ID NO:311), a second amino acid sequence being at least 90% homologous to TGVAGLSEEASAELRHHLHSPRDHP-DENKDVSTENGHHFWSHPDREKEDEDVAKEYG HLLPGHRSQDHKVGDEGVSGEEVFAEHG-GQARGHRGHGSEDTEDSAEHRHHLPSHRS HSHQD-EDEDEVVSSEHHHHILRHGHRGHDGED-DEGEEEEEEEEEEEEASTEYGHQAHR HRGHGSEEDEDVSDGHHHHGP-SHRHQGHEED-DDDDDDDDDDDDDDDDVSIEYRHQAH RHQGH-GIEEDEDVSDGHHHRDPSHRHRSHEEDDNDDDDV STEYGHQAHRHQDHRKEE VEAVSGEHHHHVP-DHRHQGHRDEEEDEDVSTERWHQGPQH-VHHGLVDEEEEEEEITV QFGHYVASHQPRGHKS-DEEDFQDEYKTEVPHHHHHRVPREEDEEVSAELGH QAPSHR QSHQDEETGHGQRGSIKEMSHHPPGHTV-VKDRSHLRKDDSEEEKEKEEDPGSHEEDDE SSE-QGEKGTHHGSRDQEDEEDEEEGHGLSLN-QEEEEEEDKEEEEEEEDEERREERAEVG APLSPDHSEEEEEEEEGLEEDEPRFTI-IPNPLDRREEAGGASSEEESGEDTGPQDAQEYGN YQPGSLCGYCSFCNRCTECESCHCDEEN-MGEHCDQCQ corresponding to amino acids 44-657 of SRCH_HUMAN_V1 (SEQ ID NO:346), which also corresponds to amino acids 44-657 of H88495_PEA_3_P17 (SEQ ID NO:311), and a third amino acid sequence being at least 70%, optionally at least 80%, preferably at least 85%, more preferably at least 90% and most preferably at least 95% homologous to a polypeptide having the sequence GPGRHAGNAGTLTQSLDCDAGVPPPAFQ-PLSTSYIYFSE (SEQ ID NO:420) corresponding to amino acids 658-696 of H88495_PEA_3_P17 (SEQ ID NO:311), wherein said first amino acid sequence, bridging amino acid, second amino acid sequence and third amino acid sequence are contiguous and in a sequential order.

2. An isolated polypeptide encoding for a tail of H88495_PEA_3_P17 (SEQ ID NO:311), comprising a polypeptide being at least 70%, optionally at least about 80%, preferably at least about 85%, more preferably at least about 90% and most preferably at least about 95% homologous to the sequence GPGRHAGNAGTLTQSLD-CDAGVPPPAFQPLSTSYIYFSE (SEQ ID NO:420) in H88495_PEA_3_P17 (SEQ ID NO:311).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H88495_PEA_3_P17 (SEQ ID NO:311) also has the following non-silent SNPs (Single Nucleotide Polymorphisms) as listed in Table 15, (given according to their position(s) on the amino acid sequence, with the alternative amino acid(s) listed; the last column indicates whether the SNP is known or not; the presence of known SNPs in variant protein H88495_PEA_3_P17 (SEQ ID NO:311) sequence provides support for the deduced sequence of this variant protein according to the present invention).

TABLE 15

Amino acid mutations

| SNP position(s) on amino acid sequence | Alternative amino acid(s) | Previously known SNP? |
|---|---|---|
| 6 | P -> L | No |
| 6 | P -> S | No |
| 43 | N -> S | Yes |
| 96 | A -> S | Yes |
| 364 | Q -> | No |
| 580 | D -> H | Yes |

Variant protein H88495_PEA_3_P17 (SEQ ID NO:311) is encoded by the following transcript(s): H88495_PEA_3_T8 (SEQ ID NO:36), for which the sequence(s) is/are given at the end of the application. The coding portion of transcript H88495_PEA_3_T8 (SEQ ID NO:36) is shown in bold; this coding portion starts at position 743 and ends at position 2830. The transcript also has the following SNPs as listed in Table 16 (given according to their position on the nucleotide sequence, with the alternative nucleic acid listed; the last column indicates whether the SNP is known or not; the presence of known SNPs in variant protein H88495_PEA_3_P17 (SEQ ID NO:311) sequence provides support for the deduced sequence of this variant protein according to the present invention).

TABLE 16

Nucleic acid SNPs

| SNP position on nucleotide sequence | Alternative nucleic acid | Previously known SNP? |
|---|---|---|
| 223 | A -> G | Yes |
| 285 | C -> T | Yes |
| 362 | A -> C | Yes |
| 373 | G -> C | Yes |
| 628 | A -> T | No |
| 629 | G -> T | No |
| 758 | C -> T | No |
| 759 | C -> T | No |
| 847 | G -> A | Yes |
| 870 | A -> G | Yes |
| 958 | G -> A | No |
| 1028 | G -> T | Yes |
| 1321 | A -> G | Yes |
| 1834 | G -> | No |
| 1903 | C -> T | Yes |
| 2480 | G -> C | Yes |
| 2882 | G -> A | Yes |

Variant protein H88495_PEA_3_P18 (SEQ ID NO:312) according to the present invention has an amino acid sequence as given at the end of the application; it is encoded by transcript(s) H88495_PEA_3_T9 (SEQ ID NO:37). An alignment is given to the known protein (Sarcoplasmic reticulum histidine-rich calcium-binding protein precursor (SEQ ID NO:389)) at the end of the application. One or more alignments to one or more previously published protein sequences are given at the end of the application. A brief description of the relationship of the variant protein according to the present invention to each such aligned protein is as follows:

Comparison report between H88495_PEA_3_P18 (SEQ ID NO:312) and SRCH_HUMAN_V1 (SEQ ID NO:346):

1. An isolated chimeric polypeptide encoding for H88495_PEA_3_P18 (SEQ ID NO:312), comprising a first amino acid sequence being at least 90% homologous to MGHHRPWLHASVLWAGVASLLLPPAM-TQQLRGDGLGFRNRNN corresponding to amino acids 1-42 of SRCH_HUMAN_V1 (SEQ ID NO:346), which also corresponds to amino acids 1-42 of H88495_PEA_3_P18 (SEQ ID NO:312), a bridging amino acid N corresponding to amino acid 43 of H88495_PEA_3_P18 (SEQ ID NO:312), a second amino acid sequence being at least 90% homologous to TGVAGLSEEASAELRHHLHSPRDHP-DENKDVSTENGHHFWSHPDREKEDEDVAKEYG HLLPGHRSQDHKVGDEGVSGEEVFAEHG-GQARGHRGHGSEDTEDSAEHRHHLPSHRS HSHQD-EDEDEVVSSEHHHHILRHGHRGHDGED-DEGEEEEEEEEEEEEASTEYGHQAHR HRGHGSEEDEDVSDGHHHHGP-SHRHQGHEED-DDDDDDDDDDDDDDDVSIEYRHQAH RHQGH-GIEEDEDVSDGHHHRDPSHRHRSHEEDDNDDDDV STEYGHQAHRHQDHRKEE VEAVSGEHHHHVP-DHRHQGHRDEEEDEDVSTERWHQGPQH-VHHGLVDEEEEEEEITV QFGHYVASHQPRGHKS-DEEDFQDEYKTEVPHHHHHRVPREEDEEVSAELGH QAPSHR QSHQDEETGHGQRGSIKEMSHHPPGHTV-VKDRSHLRKDDSEEEKEKEEDPGSHEEDDE SSE-QGEKGTHHGSRDQEDEEDEEEGHGLSLN-QEEEEEEDKEEEEEEEDEERREERAEVG APLSPDHSEEEEEEEEGLEEDEPRFTI-IPNPLDRREEAGGASSEEESGEDT corresponding to amino acids 44-610 of SRCH_HUMAN_V1 (SEQ ID NO:346), which also corresponds to amino acids 44-610 of H88495_PEA_3_P18 (SEQ ID NO:312), and a third amino acid sequence being at least 70%, optionally at least 80%, preferably at least 85%, more preferably at least 90% and most preferably at least 95% homologous to a polypeptide having the sequence AMH corresponding to amino acids 611-613 of H88495_PEA_3_P18 (SEQ ID NO:312), wherein said first amino acid sequence, bridging amino acid, second amino acid sequence and third amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H88495_PEA_3_P18 (SEQ ID NO:312) also has the following non-silent SNPs (Single Nucleotide Polymorphisms) as listed in Table 18, (given according to their position(s) on the amino acid sequence, with the alternative amino acid(s) listed; the last column indicates whether the SNP is known or not; the presence of known SNPs in variant protein H88495_PEA_3_P18 (SEQ ID NO:312) sequence provides support for the deduced sequence of this variant protein according to the present invention).

TABLE 18

Amino acid mutations

| SNP position(s) on amino acid sequence | Alternative amino acid(s) | Previously known SNP? |
|---|---|---|
| 6 | P -> L | No |
| 6 | P -> S | No |
| 43 | N -> S | Yes |
| 96 | A -> S | Yes |
| 364 | Q -> | No |
| 580 | D -> H | Yes |

Variant protein H88495_PEA_3_P18 (SEQ ID NO:312) is encoded by the following transcript(s): H88495_PEA_3_T9 (SEQ ID NO:37), for which the sequence(s) is/are given at the end of the application. The coding portion of transcript H88495_PEA_3_T9 (SEQ ID NO:37) is shown in bold; this coding portion starts at position 743 and ends at position 2581. The transcript also has the following SNPs as listed in Table 19 (given according to their position on the nucleotide sequence, with the alternative nucleic acid listed; the last column indicates whether the SNP is known or not; the presence of known SNPs in variant protein H88495_PEA_3_P18 (SEQ ID NO:312) sequence provides support for the deduced sequence of this variant protein according to the present invention).

TABLE 19

Nucleic acid SNPs

| SNP position on nucleotide sequence | Alternative nucleic acid | Previously known SNP? |
|---|---|---|
| 223 | A -> G | Yes |
| 285 | C -> T | Yes |
| 362 | A -> C | Yes |
| 373 | G -> C | Yes |
| 628 | A -> T | No |
| 629 | G -> T | No |
| 758 | C -> T | No |
| 759 | C -> T | No |
| 847 | G -> A | Yes |
| 870 | A -> G | Yes |
| 958 | G -> A | No |
| 1028 | G -> T | Yes |
| 1321 | A -> G | Yes |
| 1834 | G -> | No |
| 1903 | C -> T | Yes |
| 2480 | G -> C | Yes |

As noted above, cluster H88495 features 22 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster H88495_PEA_3_node_0 (SEQ ID NO:164) according to the present invention is supported by 12 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 20 below describes the starting and ending position of this segment on each transcript.

TABLE 20

Segment location on transcripts

| Transcript name | Segment starting position | Segment ending position |
|---|---|---|
| H88495_PEA_3_T3 (SEQ ID NO: 31) | 1 | 665 |
| H88495_PEA_3_T4 (SEQ ID NO: 32) | 1 | 665 |
| H88495_PEA_3_T5 (SEQ ID NO: 33) | 1 | 665 |
| H88495_PEA_3_T6 (SEQ ID NO: 34) | 1 | 665 |
| H88495_PEA_3_T7 (SEQ ID NO: 35) | 1 | 665 |
| H88495_PEA_3_T8 (SEQ ID NO: 36) | 1 | 665 |
| H88495_PEA_3_T9 (SEQ ID NO: 37) | 1 | 665 |

Segment cluster H88495_PEA_3_node_1 (SEQ ID NO:165) according to the present invention is supported by 18 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 21 below describes the starting and ending position of this segment on each transcript.

TABLE 21

Segment location on transcripts

| Transcript name | Segment starting position | Segment ending position |
|---|---|---|
| H88495_PEA_3_T3 (SEQ ID NO: 31) | 666 | 1178 |
| H88495_PEA_3_T4 (SEQ ID NO: 32) | 666 | 1178 |
| H88495_PEA_3_T5 (SEQ ID NO: 33) | 666 | 1178 |
| H88495_PEA_3_T6 (SEQ ID NO: 34) | 666 | 1178 |
| H88495_PEA_3_T7 (SEQ ID NO: 35) | 666 | 1178 |
| H88495_PEA_3_T8 (SEQ ID NO: 36) | 666 | 1178 |
| H88495_PEA_3_T9 (SEQ ID NO: 37) | 666 | 1178 |

Segment cluster H88495_PEA_3_node_4 (SEQ ID NO:166) according to the present invention is supported by 22 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 22 below describes the starting and ending position of this segment on each transcript.

TABLE 22

Segment location on transcripts

| Transcript name | Segment starting position | Segment ending position |
|---|---|---|
| H88495_PEA_3_T3 (SEQ ID NO: 31) | 1210 | 1646 |
| H88495_PEA_3_T4 (SEQ ID NO: 32) | 1210 | 1646 |

TABLE 22-continued

Segment location on transcripts

| Transcript name | Segment starting position | Segment ending position |
|---|---|---|
| H88495_PEA_3_T5 (SEQ ID NO: 33) | 1210 | 1646 |
| H88495_PEA_3_T6 (SEQ ID NO: 34) | 1210 | 1646 |
| H88495_PEA_3_T7 (SEQ ID NO: 35) | 1210 | 1646 |
| H88495_PEA_3_T8 (SEQ ID NO: 36) | 1210 | 1646 |
| H88495_PEA_3_T9 (SEQ ID NO: 37) | 1210 | 1646 |

Segment cluster H88495_PEA_3_node_9 (SEQ ID NO:167) according to the present invention is supported by 31 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 23 below describes the starting and ending position of this segment on each transcript.

TABLE 23

Segment location on transcripts

| Transcript name | Segment starting position | Segment ending position |
|---|---|---|
| H88495_PEA_3_T3 (SEQ ID NO: 31) | 1819 | 2335 |
| H88495_PEA_3_T4 (SEQ ID NO: 32) | 1819 | 2335 |
| H88495_PEA_3_T5 (SEQ ID NO: 33) | 1819 | 2335 |
| H88495_PEA_3_T6 (SEQ ID NO: 34) | 1819 | 2335 |
| H88495_PEA_3_T7 (SEQ ID NO: 35) | 1819 | 2335 |
| H88495_PEA_3_T8 (SEQ ID NO: 36) | 1819 | 2335 |
| H88495_PEA_3_T9 (SEQ ID NO: 37) | 1819 | 2335 |

Segment cluster H88495_PEA_3_node_13 (SEQ ID NO:168) according to the present invention is supported by 34 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 24 below describes the starting and ending position of this segment on each transcript.

TABLE 24

Segment location on transcripts

| Transcript name | Segment starting position | Segment ending position |
|---|---|---|
| H88495_PEA_3_T3 (SEQ ID NO: 31) | 2378 | 2509 |
| H88495_PEA_3_T4 (SEQ ID NO: 32) | 2378 | 2509 |
| H88495_PEA_3_T5 (SEQ ID NO: 33) | 2378 | 2509 |
| H88495_PEA_3_T6 (SEQ ID NO: 34) | 2378 | 2509 |
| H88495_PEA_3_T7 (SEQ ID NO: 35) | 2378 | 2509 |
| H88495_PEA_3_T8 (SEQ ID NO: 36) | 2378 | 2509 |
| H88495_PEA_3_T9 (SEQ ID NO: 37) | 2378 | 2509 |

Segment cluster H88495_PEA_3_node_19 (SEQ ID NO:169) according to the present invention is supported by 4 libraries. The number of libraries was determined as previously described. This segment can be found in the following transcript(s): H88495_PEA_3_T3 (SEQ ID NO:31), H88495_PEA_3_T4 (SEQ ID NO:32) and H88495_PEA_3_T7 (SEQ ID NO:35). Table 25 below describes the starting and ending position of this segment on each transcript.

TABLE 25

Segment location on transcripts

| Transcript name | Segment starting position | Segment ending position |
|---|---|---|
| H88495_PEA_3_T3 (SEQ ID NO: 31) | 2714 | 2964 |
| H88495_PEA_3_T4 (SEQ ID NO: 32) | 2714 | 2964 |
| H88495_PEA_3_T7 (SEQ ID NO: 35) | 2714 | 2964 |

Segment cluster H88495_PEA_3_node_21 (SEQ ID NO:170) according to the present invention is supported by 1 libraries. The number of libraries was determined as previously described. This segment can be found in the following transcript(s): H88495_PEA_3_T5 (SEQ ID NO:33), H88495_PEA_3_T6 (SEQ ID NO:34) and H88495_PEA_3_T7 (SEQ ID NO:35). Table 26 below describes the starting and ending position of this segment on each transcript.

TABLE 26

Segment location on transcripts

| Transcript name | Segment starting position | Segment ending position |
|---|---|---|
| H88495_PEA_3_T5 (SEQ ID NO: 33) | 2769 | 3095 |
| H88495_PEA_3_T6 (SEQ ID NO: 34) | 2769 | 3095 |
| H88495_PEA_3_T7 (SEQ ID NO: 35) | 3020 | 3346 |

Segment cluster H88495_PEA_3_node_26 (SEQ ID NO:171) according to the present invention is supported by 26 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 27 below describes the starting and ending position of this segment on each transcript.

TABLE 27

Segment location on transcripts

| Transcript name | Segment starting position | Segment ending position |
|---|---|---|
| H88495_PEA_3_T3 (SEQ ID NO: 31) | 3057 | 3189 |
| H88495_PEA_3_T4 (SEQ ID NO: 32) | 3057 | 3298 |
| H88495_PEA_3_T5 (SEQ ID NO: 33) | 3125 | 3257 |
| H88495_PEA_3_T6 (SEQ ID NO: 34) | 3125 | 3366 |
| H88495_PEA_3_T7 (SEQ ID NO: 35) | 3376 | 3508 |
| H88495_PEA_3_T8 (SEQ ID NO: 36) | 2714 | 2955 |
| H88495_PEA_3_T9 (SEQ ID NO: 37) | 2735 | 2867 |

According to an optional embodiment of the present invention, short segments related to the above cluster are also provided. These segments are up to about 120 bp in length, and so are included in a separate description.

Segment cluster H88495_PEA_3_node_2 (SEQ ID NO:172) according to the present invention is supported by 14 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 28 below describes the starting and ending position of this segment on each transcript.

TABLE 28

Segment location on transcripts

| Transcript name | Segment starting position | Segment ending position |
|---|---|---|
| H88495_PEA_3_T3 (SEQ ID NO: 31) | 1179 | 1209 |
| H88495_PEA_3_T4 (SEQ ID NO: 32) | 1179 | 1209 |
| H88495_PEA_3_T5 (SEQ ID NO: 33) | 1179 | 1209 |
| H88495_PEA_3_T6 (SEQ ID NO: 34) | 1179 | 1209 |
| H88495_PEA_3_T7 (SEQ ID NO: 35) | 1179 | 1209 |
| H88495_PEA_3_T8 (SEQ ID NO: 36) | 1179 | 1209 |
| H88495_PEA_3_T9 (SEQ ID NO: 37) | 1179 | 1209 |

Segment cluster H88495_PEA_3_node_5 (SEQ ID NO:173) according to the present invention is supported by 16 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 29 below describes the starting and ending position of this segment on each transcript.

TABLE 29

Segment location on transcripts

| Transcript name | Segment starting position | Segment ending position |
|---|---|---|
| H88495_PEA_3_T3 (SEQ ID NO: 31) | 1647 | 1676 |
| H88495_PEA_3_T4 (SEQ ID NO: 32) | 1647 | 1676 |
| H88495_PEA_3_T5 (SEQ ID NO: 33) | 1647 | 1676 |
| H88495_PEA_3_T6 (SEQ ID NO: 34) | 1647 | 1676 |
| H88495_PEA_3_T7 (SEQ ID NO: 35) | 1647 | 1676 |
| H88495_PEA_3_T8 (SEQ ID NO: 36) | 1647 | 1676 |
| H88495_PEA_3_T9 (SEQ ID NO: 37) | 1647 | 1676 |

Segment cluster H88495_PEA_3_node_6 (SEQ ID NO:174) according to the present invention is supported by 14 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 30 below describes the starting and ending position of this segment on each transcript.

TABLE 30

Segment location on transcripts

| Transcript name | Segment starting position | Segment ending position |
|---|---|---|
| H88495_PEA_3_T3 (SEQ ID NO: 31) | 1677 | 1763 |
| H88495_PEA_3_T4 (SEQ ID NO: 32) | 1677 | 1763 |
| H88495_PEA_3_T5 (SEQ ID NO: 33) | 1677 | 1763 |
| H88495_PEA_3_T6 (SEQ ID NO: 34) | 1677 | 1763 |
| H88495_PEA_3_T7 (SEQ ID NO: 35) | 1677 | 1763 |
| H88495_PEA_3_T8 (SEQ ID NO: 36) | 1677 | 1763 |
| H88495_PEA_3_T9 (SEQ ID NO: 37) | 1677 | 1763 |

Segment cluster H88495_PEA_3_node_7 (SEQ ID NO:175) according to the present invention can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 31 below describes the starting and ending position of this segment on each transcript.

TABLE 31

Segment location on transcripts

| Transcript name | Segment starting position | Segment ending position |
|---|---|---|
| H88495_PEA_3_T3 (SEQ ID NO: 31) | 1764 | 1773 |
| H88495_PEA_3_T4 (SEQ ID NO: 32) | 1764 | 1773 |
| H88495_PEA_3_T5 (SEQ ID NO: 33) | 1764 | 1773 |
| H88495_PEA_3_T6 (SEQ ID NO: 34) | 1764 | 1773 |
| H88495_PEA_3_T7 (SEQ ID NO: 35) | 1764 | 1773 |
| H88495_PEA_3_T8 (SEQ ID NO: 36) | 1764 | 1773 |
| H88495_PEA_3_T9 (SEQ ID NO: 37) | 1764 | 1773 |

Segment cluster H88495_PEA_3_node_8 (SEQ ID NO:176) according to the present invention is supported by 19 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 32 below describes the starting and ending position of this segment on each transcript.

TABLE 32

Segment location on transcripts

| Transcript name | Segment starting position | Segment ending position |
|---|---|---|
| H88495_PEA_3_T3 (SEQ ID NO: 31) | 1774 | 1818 |
| H88495_PEA_3_T4 (SEQ ID NO: 32) | 1774 | 1818 |
| H88495_PEA_3_T5 (SEQ ID NO: 33) | 1774 | 1818 |
| H88495_PEA_3_T6 (SEQ ID NO: 34) | 1774 | 1818 |
| H88495_PEA_3_T7 (SEQ ID NO: 35) | 1774 | 1818 |

TABLE 32-continued

Segment location on transcripts

| Transcript name | Segment starting position | Segment ending position |
|---|---|---|
| H88495_PEA_3_T8 (SEQ ID NO: 36) | 1774 | 1818 |
| H88495_PEA_3_T9 (SEQ ID NO: 37) | 1774 | 1818 |

Segment cluster H88495_PEA_3_node_10 (SEQ ID NO:177) according to the present invention can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 33 below describes the starting and ending position of this segment on each transcript.

TABLE 33

Segment location on transcripts

| Transcript name | Segment starting position | Segment ending position |
|---|---|---|
| H88495_PEA_3_T3 (SEQ ID NO: 31) | 2336 | 2353 |
| H88495_PEA_3_T4 (SEQ ID NO: 32) | 2336 | 2353 |
| H88495_PEA_3_T5 (SEQ ID NO: 33) | 2336 | 2353 |
| H88495_PEA_3_T6 (SEQ ID NO: 34) | 2336 | 2353 |
| H88495_PEA_3_T7 (SEQ ID NO: 35) | 2336 | 2353 |
| H88495_PEA_3_T8 (SEQ ID NO: 36) | 2336 | 2353 |
| H88495_PEA_3_T9 (SEQ ID NO: 37) | 2336 | 2353 |

Segment cluster H88495_PEA_3_node_11 (SEQ ID NO:178) according to the present invention can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 34 below describes the starting and ending position of this segment on each transcript.

TABLE 34

Segment location on transcripts

| Transcript name | Segment starting position | Segment ending position |
|---|---|---|
| H88495_PEA_3_T3 (SEQ ID NO: 31) | 2354 | 2362 |
| H88495_PEA_3_T4 (SEQ ID NO: 32) | 2354 | 2362 |
| H88495_PEA_3_T5 (SEQ ID NO: 33) | 2354 | 2362 |
| H88495_PEA_3_T6 (SEQ ID NO: 34) | 2354 | 2362 |
| H88495_PEA_3_T7 (SEQ ID NO: 35) | 2354 | 2362 |
| H88495_PEA_3_T8 (SEQ ID NO: 36) | 2354 | 2362 |
| H88495_PEA_3_T9 (SEQ ID NO: 37) | 2354 | 2362 |

Segment cluster H88495_PEA_3_node_12 (SEQ ID NO:179) according to the present invention can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 35 below describes the starting and ending position of this segment on each transcript.

TABLE 35

Segment location on transcripts

| Transcript name | Segment starting position | Segment ending position |
|---|---|---|
| H88495_PEA_3_T3 (SEQ ID NO: 31) | 2363 | 2377 |
| H88495_PEA_3_T4 (SEQ ID NO: 32) | 2363 | 2377 |
| H88495_PEA_3_T5 (SEQ ID NO: 33) | 2363 | 2377 |
| H88495_PEA_3_T6 (SEQ ID NO: 34) | 2363 | 2377 |
| H88495_PEA_3_T7 (SEQ ID NO: 35) | 2363 | 2377 |
| H88495_PEA_3_T8 (SEQ ID NO: 36) | 2363 | 2377 |
| H88495_PEA_3_T9 (SEQ ID NO: 37) | 2363 | 2377 |

Segment cluster H88495_PEA_3_node_14 (SEQ ID NO:180) according to the present invention is supported by 33 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 36 below describes the starting and ending position of this segment on each transcript.

TABLE 36

Segment location on transcripts

| Transcript name | Segment starting position | Segment ending position |
|---|---|---|
| H88495_PEA_3_T3 (SEQ ID NO: 31) | 2510 | 2573 |
| H88495_PEA_3_T4 (SEQ ID NO: 32) | 2510 | 2573 |
| H88495_PEA_3_T5 (SEQ ID NO: 33) | 2510 | 2573 |
| H88495_PEA_3_T6 (SEQ ID NO: 34) | 2510 | 2573 |
| H88495_PEA_3_T7 (SEQ ID NO: 35) | 2510 | 2573 |
| H88495_PEA_3_T8 (SEQ ID NO: 36) | 2510 | 2573 |
| H88495_PEA_3_T9 (SEQ ID NO: 37) | 2510 | 2573 |

Segment cluster H88495_PEA_3_node_16 (SEQ ID NO:181) according to the present invention is supported by 33 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35) and H88495_PEA_3_T8 (SEQ ID NO:36). Table 37 below describes the starting and ending position of this segment on each transcript.

TABLE 37

Segment location on transcripts

| Transcript name | Segment starting position | Segment ending position |
|---|---|---|
| H88495_PEA_3_T3 (SEQ ID NO: 31) | 2574 | 2644 |
| H88495_PEA_3_T4 (SEQ ID NO: 32) | 2574 | 2644 |
| H88495_PEA_3_T5 (SEQ ID NO: 33) | 2574 | 2644 |
| H88495_PEA_3_T6 (SEQ ID NO: 34) | 2574 | 2644 |

TABLE 37-continued

Segment location on transcripts

| Transcript name | Segment starting position | Segment ending position |
|---|---|---|
| H88495_PEA_3_T7 (SEQ ID NO: 35) | 2574 | 2644 |
| H88495_PEA_3_T8 (SEQ ID NO: 36) | 2574 | 2644 |

Segment cluster H88495_PEA_3_node_18 (SEQ ID NO:182) according to the present invention is supported by 31 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35), H88495_PEA_3_T8 (SEQ ID NO:36) and H88495_PEA_3_T9 (SEQ ID NO:37). Table 38 below describes the starting and ending position of this segment on each transcript.

TABLE 38

Segment location on transcripts

| Transcript name | Segment starting position | Segment ending position |
|---|---|---|
| H88495_PEA_3_T3 (SEQ ID NO: 31) | 2645 | 2713 |
| H88495_PEA_3_T4 (SEQ ID NO: 32) | 2645 | 2713 |
| H88495_PEA_3_T5 (SEQ ID NO: 33) | 2645 | 2713 |
| H88495_PEA_3_T6 (SEQ ID NO: 34) | 2645 | 2713 |
| H88495_PEA_3_T7 (SEQ ID NO: 35) | 2645 | 2713 |
| H88495_PEA_3_T8 (SEQ ID NO: 36) | 2645 | 2713 |
| H88495_PEA_3_T9 (SEQ ID NO: 37) | 2574 | 2642 |

Segment cluster H88495_PEA_3_node_20 (SEQ ID NO:183) according to the present invention is supported by 27 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35) and H88495_PEA_3_T9 (SEQ ID NO:37). Table 39 below describes the starting and ending position of this segment on each transcript.

TABLE 39

Segment location on transcripts

| Transcript name | Segment starting position | Segment ending position |
|---|---|---|
| H88495_PEA_3_T3 (SEQ ID NO: 31) | 2965 | 3019 |
| H88495_PEA_3_T4 (SEQ ID NO: 32) | 2965 | 3019 |
| H88495_PEA_3_T5 (SEQ ID NO: 33) | 2714 | 2768 |
| H88495_PEA_3_T6 (SEQ ID NO: 34) | 2714 | 2768 |
| H88495_PEA_3_T7 (SEQ ID NO: 35) | 2965 | 3019 |
| H88495_PEA_3_T9 (SEQ ID NO: 37) | 2643 | 2697 |

Segment cluster H88495_PEA_3_node_23 (SEQ ID NO:184) according to the present invention can be found in the following transcript(s): H88495_PEA_3_T3 (SEQ ID NO:31), H88495_PEA_3_T4 (SEQ ID NO:32) and H88495_PEA_3_T9 (SEQ ID NO:37). Table 40 below describes the starting and ending position of this segment on each transcript.

TABLE 40

Segment location on transcripts

| Transcript name | Segment starting position | Segment ending position |
|---|---|---|
| H88495_PEA_3_T3 (SEQ ID NO: 31) | 3020 | 3027 |
| H88495_PEA_3_T4 (SEQ ID NO: 32) | 3020 | 3027 |
| H88495_PEA_3_T9 (SEQ ID NO: 37) | 2698 | 2705 |

Segment cluster H88495_PEA_3_node_24 (SEQ ID NO:185) according to the present invention is supported by 23 libraries. The number of libraries was determined as previously described. This segment can be found in the following transcript(s): H88495_PEA_3_T3 (SEQ ID NO:31), H88495_PEA_3_T4 (SEQ ID NO:32), H88495_PEA_3_T5 (SEQ ID NO:33), H88495_PEA_3_T6 (SEQ ID NO:34), H88495_PEA_3_T7 (SEQ ID NO:35) and H88495_PEA_3_T9 (SEQ ID NO:37). Table 41 below describes the starting and ending position of this segment on each transcript.

TABLE 41

Segment location on transcripts

| Transcript name | Segment starting position | Segment ending position |
|---|---|---|
| H88495_PEA_3_T3 (SEQ ID NO: 31) | 3028 | 3056 |
| H88495_PEA_3_T4 (SEQ ID NO: 32) | 3028 | 3056 |
| H88495_PEA_3_T5 (SEQ ID NO: 33) | 3096 | 3124 |
| H88495_PEA_3_T6 (SEQ ID NO: 34) | 3096 | 3124 |
| H88495_PEA_3_T7 (SEQ ID NO: 35) | 3347 | 3375 |
| H88495_PEA_3_T9 (SEQ ID NO: 37) | 2706 | 2734 |

Variant Protein Alignment to the Previously Known Protein:
Sequence name: SRCH_HUMAN_V1 (SEQ ID NO:346)
Sequence documentation:
Alignment of: H88495_PEA_3_P15 (SEQ ID NO:309)+ SRCH_HUMAN_V1 (SEQ NO:346).

| Alignment segment 1/1: | | | |
|---|---|---|---|
| Quality: | 6726.00 | Escore: | 0 |
| Matching length: | 657 | Total length: | 657 |
| Matching Percent Similarity: | 100.00 | Matching Percent Identity: | 99.85 |
| Total Percent Similarity: | 100.00 | Total Percent Identity: | 99.85 |
| Gaps: | 0 | | |

Alignment:

```
  1 MGHHRPWLHASVLWAGVASLLLPPAMTQQLRGDGLGFRNRNNNTGVAGLS   50
    ||||||||||||||||||||||||||||||||||||||||||:|||||||
  1 MGHHRPWLHASVLWAGVASLLLPPAMTQQLRGDGLGFRNRNNSTGVAGLS   50

51 EEASAELRHHLHSPRDHPDENKDVSTENGHHFWSHPDREKEDEDVAKEYG  100
    |||||||||||||||||||||||||||||||||||||||||||||||||
 51 EEASAELRHHLHSPRDHPDENKDVSTENGHHFWSHPDREKEDEDVAKEYG  100

101 HLLPGHRSQDHKVGDEGVSGEEVFAEHGGQARGHRGHGSEDTEDSAEHRH  150
    |||||||||||||||||||||||||||||||||||||||||||||||||
101 HLLPGHRSQDHKVGDEGVSGEEVFAEHGGQARGHRGHGSEDTEDSAEHRH  150

151 HLPSHRSHSHQDEDEDEVVSSEHHHHILRHGHRGHDGEDDEGEEEEEEEE  200
    |||||||||||||||||||||||||||||||||||||||||||||||||
151 HLPSHRSHSHQDEDEDEVVSSEHHHHILRHGHRGHDGEDDEGEEEEEEEE  200

201 EEEEASTEYGHQAHRHRGHGSEEDEDVSDGHHHHGPSHRHQGHEEDDDDD  250
    |||||||||||||||||||||||||||||||||||||||||||||||||
201 EEEEASTEYGHQAHRHRGHGSEEDEDVSDGHHHHGPSHRHQGHEEDDDDD  250

251 DDDDDDDDDDDVSIEYRHQAHRHQGHGIEEDEDVSDGHHHRDPSHRHRSH  300
    |||||||||||||||||||||||||||||||||||||||||||||||||
251 DDDDDDDDDDDVSIEYRHQAHRHQGHGIEEDEDVSDGHHHRDPSHRHRSH  300

301 EEDDNDDDDVSTEYGHQAHRHQDHRKEEVEAVSGEHHHHVPDHRHQGHRD  350
    |||||||||||||||||||||||||||||||||||||||||||||||||
301 EEDDNDDDDVSTEYGHQAHRHQDHRKEEVEAVSGEHHHHVPDHRHQGHRD  350

351 EEEDEDVSTERWHQGPQHVHHGLVDEEEEEEEITVQFGHYVASHQPRGHK  400
    |||||||||||||||||||||||||||||||||||||||||||||||||
351 EEEDEDVSTERWHQGPQHVHHGLVDEEEEEEEITVQFGHYVASHQPRGHK  400

401 SDEEDFQDEYKTEVPHHHHHRVPREEDEEVSAELGHQAPSHRQSHQDEET  450
    |||||||||||||||||||||||||||||||||||||||||||||||||
401 SDEEDFQDEYKTEVPHHHHHRVPREEDEEVSAELGHQAPSHRQSHQDEET  450

451 GHHQRGSIKEMSHHPPGHTVVKDRSHLRKDDSEEEKEKEEDPGSHEEDDE  500
    ||.||||||||||||||||||||||||||||||||||||||||||||||
451 GHGQRGSIKEMSHHPPGHTVVKDRSHLRKDDSEEEKEKEEDPGSHEEDDE  500

501 SSEQGEKGTHHGSRDQEDEEDEEEGHGLSLNQEEEEEEDKEEEEEEEDEE  550
    |||||||||||||||||||||||||||||||||||||||||||||||||
501 SSEQGEKGTHHGSRDQEDEEDEEEGHGLSLNQEEEEEEDKEEEEEEEDEE  550

551 RREERAEVGAPLSPDHSEEEEEEEEGLEEDEPRFTIIPNPLDRREEAGGA  600
    |||||||||||||||||||||||||||||||||||||||||||||||||
551 RREERAEVGAPLSPDHSEEEEEEEEGLEEDEPRFTIIPNPLDRREEAGGA  600

601 SSEEESGEDTGPQDAQEYGNYQPGSLCGYCSFCNRCTECESCHCDEENMG  650
    |||||||||||||||||||||||||||||||||||||||||||||||||
601 SSEEESGEDTGPQDAQEYGNYQPGSLCGYCSFCNRCTECESCHCDEENMG  650

651 EHCDQCQ  657
    |||||||
651 EHCDQCQ  657
```

Sequence name: SRCH_HUMAN_V1 (SEQ ID NO:346)

Sequence documentation:

Alignment of: H88495_PEA_3_P16 (SEQ ID NO:310)+ SRCH_HUMAN_V1 (SEQ ID NO:346).

| Alignment segment 1/1: | | | |
|---|---|---|---|
| Quality: | 6935.00 | Escore: | 0 |
| Matching length: | 676 | Total length: | 676 |
| Matching Percent Similarity: | 100.00 | Matching Percent Identity: | 99.85 |
| Total Percent Similarity: | 100.00 | Total Percent Identity: | 99.85 |
| Gaps: | 0 | | |

Alignment:

```
  1 MGHHRPWLHASVLWAGVASLLLPPAMTQQLRGDGLGFRNRNNNTGVAGLS   50
    |||||||||||||||||||||||||||||||||||||||||:||||||||
  1 MGHHRPWLHASVLWAGVASLLLPPAMTQQLRGDGLGFRNRNNSTGVAGLS   50

51 EEASAELRHHLHSPRDHPDENKDVSTENGHHFWSHPDREKEDEDVAKEYG  100
    |||||||||||||||||||||||||||||||||||||||||||||||||
 51 EEASAELRHHLHSPRDHPDENKDVSTENGHHFWSHPDREKEDEDVAKEYG  100

101 HLLPGHRSQDHKVGDEGVSGEEVFAEHGGQARGHRGHGSEDTEDSAEHRH  150
    |||||||||||||||||||||||||||||||||||||||||||||||||
101 HLLPGHRSQDHKVGDEGVSGEEVFAEHGGQARGHRGHGSEDTEDSAEHRH  150

151 HLPSHRSHSHQDEDEDEVVSSEHHHHILRHGHRGHDGEDDEGEEEEEEEE  200
    |||||||||||||||||||||||||||||||||||||||||||||||||
151 HLPSHRSHSHQDEDEDEVVSSEHHHHILRHGHRGHDGEDDEGEEEEEEEE  200

201 EEEEASTEYGHQAHRHRGHGSEEDEDVSDGHHHHGPSHRHQGHEEDDDDD  250
    |||||||||||||||||||||||||||||||||||||||||||||||||
201 EEEEASTEYGHQAHRHRGHGSEEDEDVSDGHHHHGPSHRHQGHEEDDDDD  250

251 DDDDDDDDDDDVSIEYRHQAHRHQGHGIEEDEDVSDGHHHRDPSHRHRSH  300
    |||||||||||||||||||||||||||||||||||||||||||||||||
251 DDDDDDDDDDDVSIEYRHQAHRHQGHGIEEDEDVSDGHHHRDPSHRHRSH  300

301 EEDDNDDDDVSTEYGHQAHRHQDHRKEEVEAVSGEHHHHVPDHRHQGHRD  350
    |||||||||||||||||||||||||||||||||||||||||||||||||
301 EEDDNDDDDVSTEYGHQAHRHQDHRKEEVEAVSGEHHHHVPDHRHQGHRD  350

351 EEEDEDVSTERWHQGPQHVHHGLVDEEEEEEEITVQFGHYVASHQPRGHK  400
    |||||||||||||||||||||||||||||||||||||||||||||||||
351 EEEDEDVSTERWHQGPQHVHHGLVDEEEEEEEITVQFGHYVASHQPRGHK  400

401 SDEEDFQDEYKTEVPHHHHHRVPREEDEEVSAELGHQAPSHRQSHQDEET  450
    |||||||||||||||||||||||||||||||||||||||||||||||||
401 SDEEDFQDEYKTEVPHHHHHRVPREEDEEVSAELGHQAPSHRQSHQDEET  450

451 GHGQRGSIKEMSHHPPGHTVVKDRSHLRKDDSEEEKEKEEDPGSHEEDDE  500
    |||||||||||||||||||||||||||||||||||||||||||||||||
451 GHGQRGSIKEMSHHPPGHTVVKDRSHLRKDDSEEEKEKEEDPGSHEEDDE  500

501 SSEQGEKGTHHGSRDQEDEEDEEEGHGLSLNQEEEEEEDKEEEEEEDEE  550
    |||||||||||||||||||||||||||||||||||||||||||||||||
501 SSEQGEKGTHHGSRDQEDEEDEEEGHGLSLNQEEEEEEDKEEEEEEDEE  550

551 RREERAEVGAPLSPDHSEEEEEEEEGLEEDEPRFTIIPNPLDRREEAGGA  600
    |||||||||||||||||||||||||||||||||||||||||||||||||
551 RREERAEVGAPLSPDHSEEEEEEEEGLEEDEPRFTIIPNPLDRREEAGGA  600

601 SSEEESGEDTGPQDAQEYGNYQPGSLCGYCSFCNRCTECESCHCDEENMG  650
    |||||||||||||||||||||||||||||||||||||||||||||||||
601 SSEEESGEDTGPQDAQEYGNYQPGSLCGYCSFCNRCTECESCHCDEENMG  650

651 EHCDQCQHCQFCYLCPLVCETVCAPG                         676
    ||||||||||||||||||||||||||
651 EHCDQCQHCQFCYLCPLVCETVCAPG                         676
```

Sequence name: SRCH_HUMAN_V1 (SEQ ID NO:346)

Sequence documentation:

Alignment of: H88495_PEA_3_P17 (SEQ ID NO:311)+ SRCH_HUMAN_V1 (SEQ ID NO:346).

| Alignment segment 1/1: | | |
|---|---|---|
| Quality: | 6726.00 | Escore: 0 |
| Matching length: | 657 | Total length: 657 |
| Matching Percent Similarity: | 100.00 | Matching Percent Identity: 99.85 |
| Total Percent Similarity: | 100.00 | Total Percent Identity: 99.85 |
| Gaps: | 0 | |

Alignment:

```
  1  MGHHRPWLHASVLWAGVASLLLPPAMTQQLRGDGLGFRNRNNNTGVAGLS   50
     ||||||||||||||||||||||||||||||||||||||||||:||||||
  1  MGHHRPWLHASVLWAGVASLLLPPAMTQQLRGDGLGFRNRNN.STGVAGLS   50

51  EEASAELRHHLHSPRDHPDENKDVSTENGHHFWSHPDREKEDEDVAKEYG  100
     |||||||||||||||||||||||||||||||||||||||||||||||||
 51  EEASAELRHHLHSPRDHPDENKDVSTENGHHFWSHPDREKEDEDVAKEYG  100

101  HLLPGHRSQDHKVGDEGVSGEEVFAEHGGQARGHRGHGSEDTEDSAEHRH  150
     |||||||||||||||||||||||||||||||||||||||||||||||||
101  HLLPGHRSQDHKVGDEGVSGEEVFAEHGGQARGHRGHGSEDTEDSAEHRH  150

151  HLPSHRSHSHQDEDEDEVVSSEHHHHILRHGHRGHDGEDDEGEEEEEEEE  200
     |||||||||||||||||||||||||||||||||||||||||||||||||
151  HLPSHRSHSHQDEDEDEVVSSEHHHHILRHGHRGHDGEDDEGEEEEEEEE  200

201  EEEEASTEYGHQAHRHRGHGSEEDEDVSDGHHHHGPSHRHQGHEEDDDDD  250
     |||||||||||||||||||||||||||||||||||||||||||||||||
201  EEEEASTEYGHQAHRHRGHGSEEDEDVSDGHHHHGPSHRHQGHEEDDDDD  250

251  DDDDDDDDDDDVSIEYRHQAHRHQGHGIEEDEDVSDGHHHRDPSHRHRSH  300
     |||||||||||||||||||||||||||||||||||||||||||||||||
251  DDDDDDDDDDDVSIEYRHQAHRHQGHGIEEDEDVSDGHHHRDPSHRHRSH  300

301  EEDDNDDDDVSTEYGHQAHRHQDHRKEEVEAVSGEHHHHVPDHRHQGHRD  350
     |||||||||||||||||||||||||||||||||||||||||||||||||
301  EEDDNDDDDVSTEYGHQAHRHQDHRKEEVEAVSGEHHHHVPDHRHQGHRD  350

351  EEEDEDVSTERWHQGPQHVHHGLVDEEEEEEEITVQFGHYVASHQPRGHK  400
     |||||||||||||||||||||||||||||||||||||||||||||||||
351  EEEDEDVSTERWHQGPQHVHHGLVDEEEEEEEITVQFGHYVASHQPRGHK  400

401  SDEEDFQDEYKTEVPHHHHHRVPREEDEEVSAELGHQAPSHRQSHQDEET  450
     |||||||||||||||||||||||||||||||||||||||||||||||||
401  SDEEDFQDEYKTEVPHHHHHRVPREEDEEVSAELGHQAPSHRQSHQDEET  450

451  GHGQRGSIKEMSHHPPGHTVVKDRSHLRKDDSEEEKEKEEDPGSHEEDDE  500
     |||||||||||||||||||||||||||||||||||||||||||||||||
451  GHGQRGSIKEMSHHPPGHTVVKDRSHLRKDDSEEEKEKEEDPGSHEEDDE  500

501  SSEQGEKGTHHGSRDQEDEEDEEEGHGLSLNQEEEEEEDKEEEEEEEDEE  550
     |||||||||||||||||||||||||||||||||||||||||||||||||
501  SSEQGEKGTHHGSRDQEDEEDEEEGHGLSLNQEEEEEEDKEEEEEEEDEE  550

551  RREEDRAEVGAPLSPDHSEEEEEEEEGLEEDEPRFTIIPNPLDRREEAGGA  600
     ||||.|||||||||||||||||||||||||||||||||||||||||||||
551  RREERAEVGAPLSPDHSEEEEEEEEGLEEDEPRFTIIPNPLDRREEAGGA  600

601  SSEEESGEDTGPQDAQEYGNYQPGSLCGYCSFCNRCTECESCHCDEENMG  650
     |||||||||||||||||||||||||||||||||||||||||||||||||
601  SSEEESGEDTGPQDAQEYGNYQPGSLCGYCSFCNRCTECESCHCDEENMG  650

651  EHCDQCQ   657
     |||||||
651  EHCDQCQ   657
```

Sequence name: SRCH_HUMAN_V1 (SEQ ID NO:346)
Sequence documentation:
Alignment of: H88495_PEA_3_P18 (SEQ ID NO:312)+
SRCH_HUMAN_V1 (SEQ ID NO:346).

Alignment segment 1/1:

| | | |
|---|---|---|
| Quality: | 6206.00 | Escore: 0 |
| Matching length: | 610 | Total length: 610 |
| Matching Percent Similarity: | 100.00 | Matching Percent Identity: 99.84 |
| Total Percent Similarity: | 100.00 | Total Percent Identity: 99.84 |
| Gaps: | 0 | |

Alignment:

```
  1 MGHHRPWLHASVLWAGVASLLLPPAMTQQLRGDGLGFRNRNNNTGVAGLS   50
    |||||||||||||||||||||||||||||||||||||||:||||||||||
  1 MGHHRPWLHASVLWAGVASLLLPPAMTQQLRGDGLGFRNRNNSTGVAGLS   50

51 EEASAELRHHLHSPRDHPDENKDVSTENGHHFWSHPDREKEDEDVAKEYG  100
    ||||||||||||||||||||||||||||||||||||||||||||||||||
 51 EEASAELRHHLHSPRDHPDENKDVSTENGHHFWSHPDREKEDEDVAKEYG  100

101 HLLPGHRSQDHKVGDEGVSGEEVFAEHGGQARGHRGHGSEDTEDSAEHRH  150
    ||||||||||||||||||||||||||||||||||||||||||||||||||
101 HLLPGHRSQDHKVGDEGVSGEEVFAEHGGQARGHRGHGSEDTEDSAEHRH  150

151 HLPSHRSHSHQDEDEDEVVSSEHHHHILRHGHRGHDGEDDEGEEEEEEEE  200
    ||||||||||||||||||||||||||||||||||||||||||||||||||
151 HLPSHRSHSHQDEDEDEVVSSEHHHHILRHGHRGHDGEDDEGEEEEEEEE  200

201 EEEEASTEYGHQAHRHRGHGSEEDEDVSDGHHHHGPSHRHQGHEEDDDDD  250
    ||||||||||||||||||||||||||||||||||||||||||||||||||
201 EEEEASTEYGHQAHRHRGHGSEEDEDVSDGHHHHGPSHRHQGHEEDDDDD  250

251 DDDDDDDDDDVSIEYRHQAHRHQGHGIEEDEDVSDGHHHRDPSHRHRSH  300
    ||||||||||||||||||||||||||||||||||||||||||||||||||
251 DDDDDDDDDDVSIEYRHQAHRHQGHGIEEDEDVSDGHHHRDPSHRHRSH  300

301 EEDDNDDDDVSTEYGHQAHRHQDHRKEEVEAVSGEHHHHVPDHRHQGHRD  350
    ||||||||||||||||||||||||||||||||||||||||||||||||||
301 EEDDNDDDDVSTEYGHQAHRHQDHRKEEVEAVSGEHHHHVPDHRHQGHRD  350

351 EEEDEDVSTERWHQGPQHVHHGLVDEEEEEEEITVQFGHYVASHQPRGHK  400
    ||||||||||||||||||||||||||||||||||||||||||||||||||
351 EEEDEDVSTERWHQGPQHVHHGLVDEEEEEEEITVQFGHYVASHQPRGHK  400

401 SDEEDFQDEYKTEVPHHHHHRVPREEDEEVSAELGHQAPSHRQSHQDEET  450
    ||||||||||||||||||||||||||||||||||||||||||||||||||
401 SDEEDFQDEYKTEVPHHHHHRVPREEDEEVSAELGHQAPSHRQSHQDEET  450

451 GHGQRGSIKEMSHHPPGHTVVKDRSHLRKDDSEEEKEKEEDPGSHEEDDE  500
    ||||||||||||||||||||||||||||||||||||||||||||||||||
451 GHGQRGSIKEMSHHPPGHTVVKDRSHLRKDDSEEEKEKEEDPGSHEEDDE  500

501 SSEQGEKGTHHGSRDQEDEEDEEEGHGLSLNQEEEEEEDKEEEEEEEDEE  550
    ||||||||||||||||||||||||||||||||||||||||||||||||||
501 SSEQGEKGTHHGSRDQEDEEDEEEGHGLSLNQEEEEEEDKEEEEEEEDEE  550

551 RREERAEVGAPLSPDHSEEEEEEEEGLEEDEPRFTIIPNPLDRREEAGGA  600
    ||||||||||||||||||||||||||||||||||||||||||||||||||
551 RREERAEVGAPLSPDHSEEEEEEEEGLEEDEPRFTIIPNPLDRREEAGGA  600

601 SSEEESGEDT                                         610
    ||||||||||
601 SSEEESGEDT                                         610
```

Description for Cluster Z36249

Cluster Z36249 features 4 transcript(s) and 11 segment(s) of interest, the names for which are given in Tables 1 and 2, respectively, the sequences themselves are given at the end of the application. The selected protein variants are given in table 3.

TABLE 1

Transcripts of interest

| Transcript Name | Seq ID No. |
| --- | --- |
| Z36249_PEA_3_T2 | 38 |
| Z36249_PEA_3_T3 | 39 |
| Z36249_PEA_3_T5 | 40 |
| Z36249_PEA_3_T9 | 41 |

TABLE 2

Segments of interest

| Segment Name | Seq ID No. |
| --- | --- |
| Z36249_PEA_3_node_0 | 186 |
| Z36249_PEA_3_node_3 | 187 |
| Z36249_PEA_3_node_5 | 188 |
| Z36249_PEA_3_node_11 | 189 |
| Z36249_PEA_3_node_14 | 190 |
| Z36249_PEA_3_node_24 | 191 |
| Z36249_PEA_3_node_10 | 192 |
| Z36249_PEA_3_node_13 | 193 |
| Z36249_PEA_3_node_17 | 194 |
| Z36249_PEA_3_node_19 | 195 |
| Z36249_PEA_3_node_21 | 196 |

TABLE 3

Proteins of interest

| Protein Name | Seq ID No. | Corresponding Transcript(s) |
|---|---|---|
| Z36249_PEA_3_P2 | 313 | Z36249_PEA_3_T2 (SEQ ID NO: 38) |
| Z36249_PEA_3_P3 | 314 | Z36249_PEA_3_T3 (SEQ ID NO: 39) |
| Z36249_PEA_3_P4 | 315 | Z36249_PEA_3_T5 (SEQ ID NO: 40) |
| Z36249_PEA_3_P5 | 316 | Z36249_PEA_3_T9 (SEQ ID NO: 41) |

The heart-selective diagnostic marker prediction engine provided the following results with regard to cluster Z36249. Predictions were made for selective expression of transcripts of this cluster in heart tissue, according to the previously described methods. The numbers on the y-axis of FIG. 27 refer to weighted expression of ESTs in each category, as "parts per million" (ratio of the expression of ESTs for a particular cluster to the expression of all ESTs in that category, according to parts per million).

Figure 27:
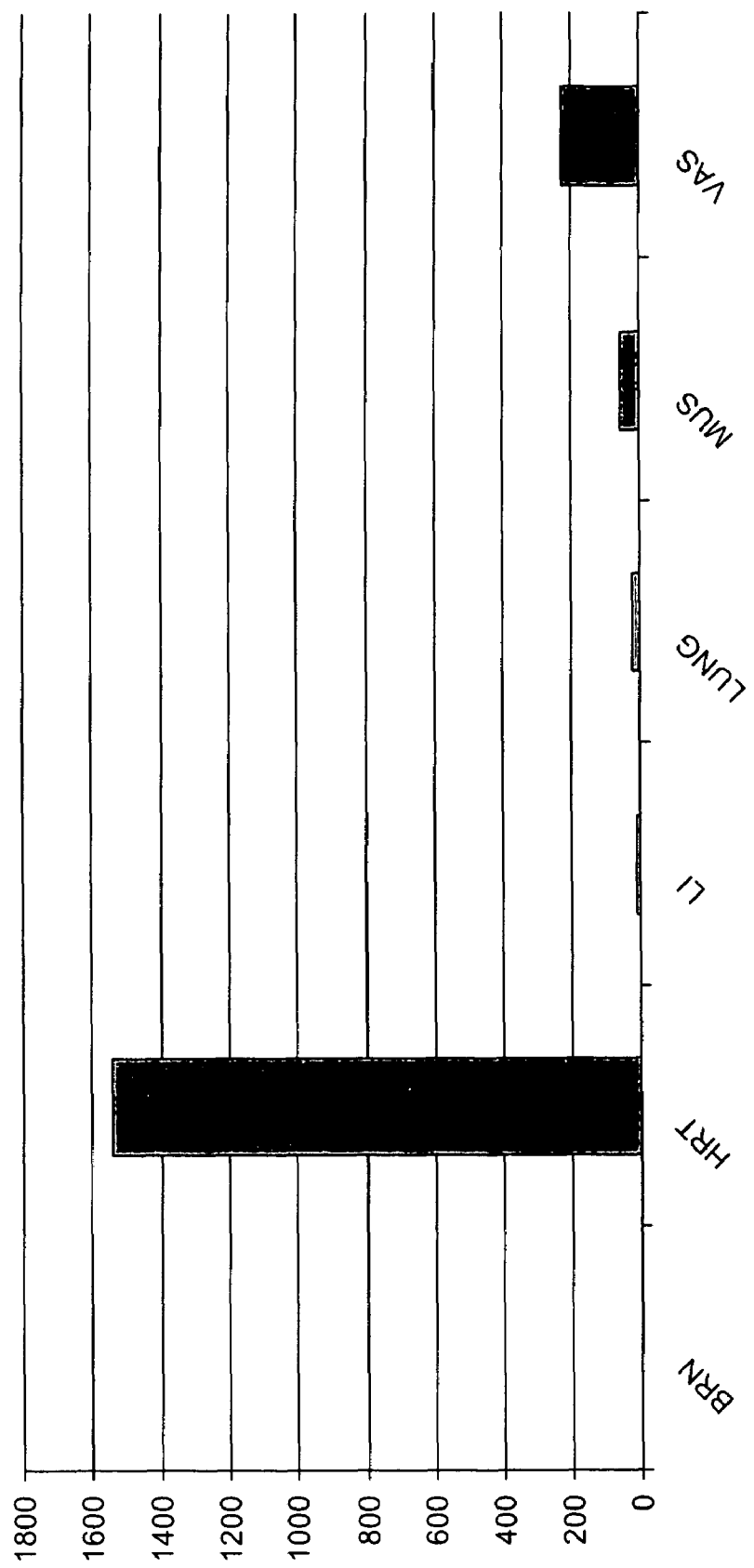
FIG. 27 is a histogram showing ESTs concerning the number of heart-specific clones in libraries/sequences.
Figure 28:
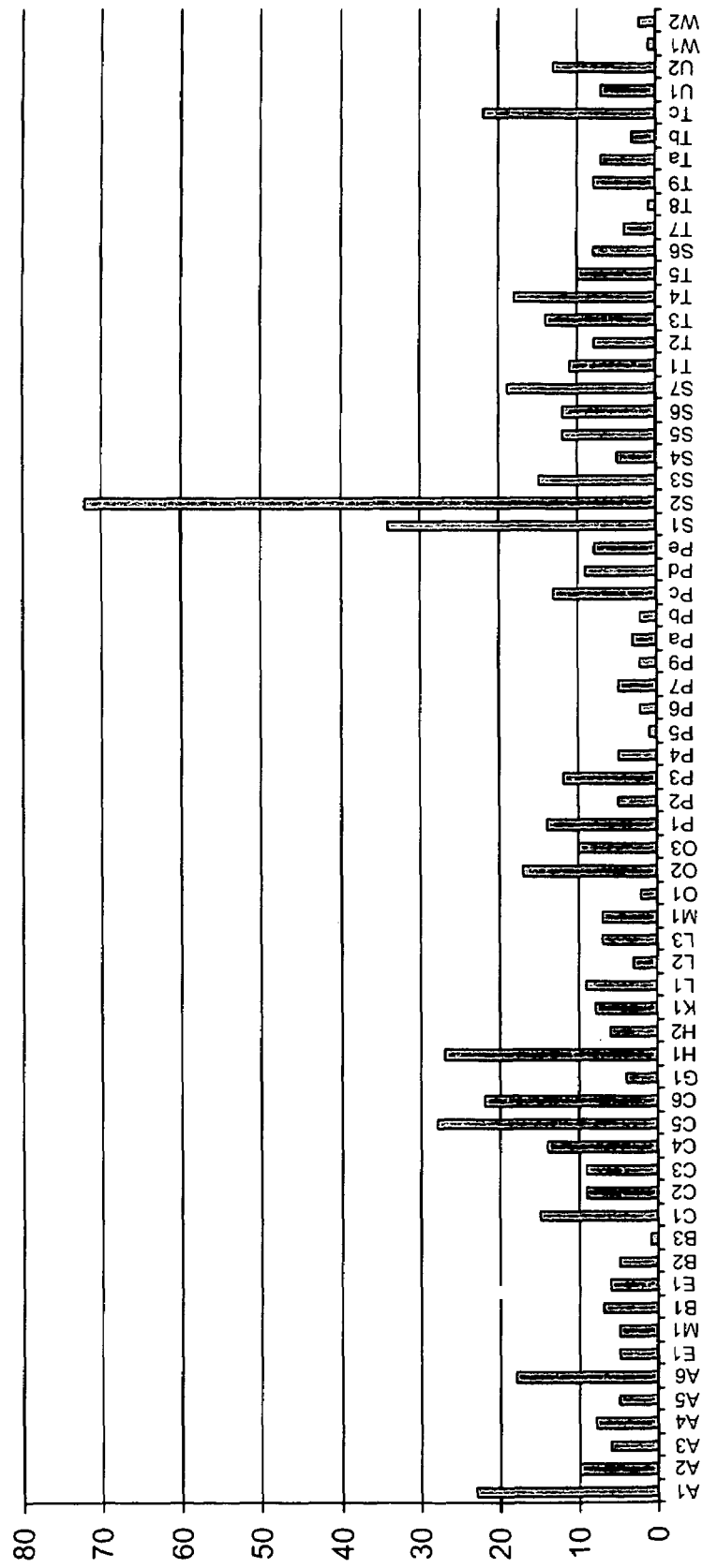
FIG. 28 is a histogram concerning the actual expression of oligonucleotides in various tissues, prob 206029_at (SEQ ID NO:393), including heart tissue.

Overall, the following results were obtained as shown with regard to the histogram in FIG. 27, concerning the number of heart-specific clones in libraries/sequences; as well as with regard to the histogram in FIG. 28, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 33.8; the ratio of expression of the cluster in heart specific ESTs to the overall expression of the cluster in muscle-specific ESTs which was found to be 27.8; and fisher exact test P-values were computed both for library and weighted clone counts to check that the counts are statistically significant, and were found to be 1.60E-47.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 33.8, which clearly supports specific expression in heart tissue As noted above, cluster Z36249 features 4 transcript(s), which were listed in Table 1 above. A description of each variant protein according to the present invention is now provided.

Variant protein Z36249_PEA_3_P2 (SEQ ID NO:313) according to the present invention has an amino acid sequence as given at the end of the application; it is encoded by transcript(s) Z36249_PEA_3_T2 (SEQ ID NO:38). One or more alignments to one or more previously published protein sequences are given at the end of the application. A brief description of the relationship of the variant protein according to the present invention to each such aligned protein is as follows:

Comparison report between Z36249_PEA_3_P2 (SEQ ID NO:313) and Q96LE7 (SEQ ID NO:344):

1. An isolated chimeric polypeptide encoding for Z36249_PEA_3_P2 (SEQ ID NO:313), comprising a first amino acid sequence being at least 90% homologous to MMVLKVEELVTGKKNGNGEAGEFLPED-FRDGEYEAAVTLEKQEDLKTLLAHPVTLGE QQWK-SEKQREAELKKKKLEQRSKLEN-LEDLEIIIQLKKRKKYRKTKVPVVKEPEPEII corresponding to amino acids 1-115 of Q96LE7 (SEQ ID NO:344), which also corresponds to amino acids 1-115 of Z36249_PEA_3_P2 (SEQ ID NO:313), and a second amino acid sequence being at least 90% homologous to YKRTAL-HRACLEGHLAIVEKLMEAGAQIEFRD-MLESTAIHWASRGGNLDVLKLLLNKG AKISARD-KLLSTALHVAVRTGHYECAEHLIACEADLNAKDREG DTPLHDAVRLNRYK MIRLLIMYGADLNIKNCAGK-TPMDLVLHWQNGTKAIFDSLRENSYKTSRIATF corresponding to amino acids 152-319 of Q96LE7 (SEQ ID NO:344), which also corresponds to amino acids 116-283 of Z36249_PEA_3_P2 (SEQ ID NO:313), wherein said first amino acid sequence and second amino acid sequence are contiguous and in a sequential order.

2. An isolated chimeric polypeptide encoding for an edge portion of Z36249_PEA_3_P2 (SEQ ID NO:313), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IY, having a structure as follows: a sequence starting from any of amino acid numbers 115−x to 115; and ending at any of amino acid numbers 116+((n−2)−x), in which x varies from 0 to n−2.

Comparison report between Z36249_PEA_3_P2 (SEQ ID NO:313) and Q15327 (SEQ ID NO:345):

1. An isolated chimeric polypeptide encoding for Z36249_PEA_3_P2 (SEQ ID NO:313), comprising a first amino acid sequence being at least 90% homologous to MMVLKVEELVTGKKNGNGEAGEFLPED-FRDGEYEAAVTLEKQEDLKTLLAHPVTLGE QQWK-SEKQREAEL corresponding to amino acids 1-70 of Q15327 (SEQ ID NO:345), which also corresponds to amino acids 1-70 of Z36249_PEA_3_P2 (SEQ ID NO:313), a bridging amino acid K corresponding to amino acid 71 of Z36249_PEA_3_P2 (SEQ ID NO:313), a second amino acid sequence being at least 90% homologous to KKKLEQRSKLENLEDLEII-IQLKKRKKYRKTKVPVVKEPEPEII corresponding to amino acids 72-115 of Q15327 (SEQ ID NO:345), which also corresponds to amino acids 72-115 of Z36249_PEA_3_P2 (SEQ ID NO:313), and a third amino acid sequence being at least 90% homologous to YKRTALHRA-CLEGHLAIVEKLMEAGAQIEFRD-MLESTAIHWASRGGNLDVLKLLLNKG AKISARD-KLLSTALHVAVRTGHYECAEHLIACEADLNAKDREG DTPLHDAVRLNRYK MIRLLIMYGADLNIKNCAGK-TPMDLVLHWQNGTKAIFDSLRENSYKTSRIATF corresponding to amino acids 152-319 of Q15327 (SEQ ID NO:345), which also corresponds to amino acids 116-283 of Z36249_PEA_3_P2 (SEQ ID NO:313), wherein said first amino acid sequence, bridging amino acid, second amino acid sequence and third amino acid sequence are contiguous and in a sequential order.

2. An isolated chimeric polypeptide encoding for an edge portion of Z36249_PEA_3_P2 (SEQ ID NO:313), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IY, having a structure as follows: a sequence starting from any of amino acid numbers 115-x to 115; and ending at any of amino acid numbers 116+((n-2)-x), in which x varies from 0 to n-2.

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein Z36249_PEA_3_P2 (SEQ ID NO:313) also has the following non-silent SNPs (Single Nucleotide Polymorphisms) as listed in Table 4, (given according to their position(s) on the amino acid sequence, with the alternative amino acid(s) listed; the last column indicates whether the SNP is known or not; the presence of known SNPs in variant protein Z36249_PEA_3_P2 (SEQ ID NO:313) sequence provides support for the deduced sequence of this variant protein according to the present invention).

TABLE 4

Amino acid mutations

| SNP position(s) on amino acid sequence | Alternative amino acid(s) | Previously known SNP? |
|---|---|---|
| 34 | E -> * | Yes |

Variant protein Z36249_PEA_3_P2 (SEQ ID NO:313) is encoded by the following transcript(s): Z36249_PEA_3_T2 (SEQ ID NO:38), for which the sequence(s) is/are given at the end of the application. The coding portion of transcript Z36249_PEA_3_T2 (SEQ ID NO:38) is shown in bold; this coding portion starts at position 250 and ends at position 1098. The transcript also has the following SNPs as listed in Table 5 (given according to their position on the nucleotide sequence, with the alternative nucleic acid listed; the last column indicates whether the SNP is known or not; the presence of known SNPs in variant protein Z36249_PEA_3_P2 (SEQ ID NO:313) sequence provides support for the deduced sequence of this variant protein according to the present invention).

TABLE 5

Nucleic acid SNPs

| SNP position on nucleotide sequence | Alternative nucleic acid | Previously known SNP? |
|---|---|---|
| 105 | T -> C | Yes |
| 208 | T -> | No |
| 349 | G -> T | Yes |
| 459 | C -> A | No |
| 1160 | A -> G | Yes |
| 1356 | C -> T | Yes |
| 1417 | C -> T | Yes |
| 1516 | C -> T | Yes |
| 1601 | C -> T | Yes |
| 1705 | G -> A | Yes |
| 1761 | G -> A | Yes |
| 1969 | G -> A | Yes |
| 1974 | G -> A | Yes |
| 2047 | G -> A | Yes |

Variant protein Z36249_PEA_3_P3 (SEQ ID NO:314) according to the present invention has an amino acid sequence as given at the end of the application; it is encoded by transcript(s) Z36249_PEA_3_T3 (SEQ ID NO:39). One or more alignments to one or more previously published protein sequences are given at the end of the application. A brief description of the relationship of the variant protein according to the present invention to each such aligned protein is as follows:

Comparison report between Z36249$_{13}$ PEA_3_P3 (SEQ ID NO:314) and Q96LE7 (SEQ ID NO:344):

1. An isolated chimeric polypeptide encoding for Z36249_PEA_3_P3 (SEQ ID NO:314), comprising a first amino acid sequence being at least 90% homologous to MMVLKVEELVTGKKNGNGEAGEFLPED-FRDGEYEAAVTLEKQEDLKTLLAHPVTLGE QQWK-SEKQREAELKKKKLEQRSKLEN-LEDLEIIIQLKKRKKYRKTKVPVVKEPEPEIITE PVDVPTFLKAALENKLPVVEKFLSDKN-NPDVCDEYKRTALHRACLEGHLAIVEKLMEA GAQIEFRDM corresponding to amino acids 1-184 of Q96LE7 (SEQ ID NO:344), which also corresponds to amino acids 1-184 of Z36249_PEA_3_P3 (SEQ ID NO:314), and a second amino acid sequence being at least 70%, optionally at least 80%, preferably at least 85%, more preferably at least 90% and most preferably at least 95% homologous to a polypeptide having the sequence VNI-FLCLGMSQKK (SEQ ID NO:421) corresponding to amino acids 185-197 of Z36249_PEA_3_P3 (SEQ ID NO:314), wherein said first amino acid sequence and second amino acid sequence are contiguous and in a sequential order.

2. An isolated polypeptide encoding for a tail of Z36249_PEA_3_P3 (SEQ ID NO:314), comprising a polypeptide being at least 70%, optionally at least about 80%, preferably at least about 85%, more preferably at least about 90% and most preferably at least about 95% homologous to the sequence VNIFLCLGMSQKK (SEQ ID NO:421) in Z36249_PEA_3_P3 (SEQ ID NO:314).

Comparison report between Z36249_PEA_3_P3 (SEQ ID NO:314) and Q15327 (SEQ ID NO:345):

1. An isolated chimeric polypeptide encoding for Z36249_PEA_3_P3 (SEQ ID NO:314), comprising a first amino acid sequence being at least 90% homologous to MMVLKVEELVTGKKNGNGEAGEFLPED-FRDGEYEAAVTLEKQEDLKTLLAHPVTLGE QQWK-SEKQREAEL corresponding to amino acids 1-70 of Q15327 (SEQ ID NO:345), which also corresponds to amino acids 1-70 of Z36249_PEA_3_P3 (SEQ ID NO:314), a bridging amino acid K corresponding to amino acid 71 of Z36249_PEA_3_P3 (SEQ ID NO:314), a second amino acid sequence being at least 90% homologous to KKKLEQRSKLENLEDLEII-IQLKKRKKYRKTKVPVVKEPEPEI-ITEPVDVPTFLKAALENK LPVVEKFLSDKNNPD-VCDEYKRTALHRACLEGHLAIVEKLMEAGAQIEFR-DM corresponding to amino acids 72-184 of Q15327 (SEQ ID NO:345), which also corresponds to amino acids 72-184 of Z36249_PEA_3_P3 (SEQ ID NO:314), and a third amino acid sequence being at least 70%, optionally at least 80%, preferably at least 85%, more preferably at least 90% and most preferably at least 95% homologous to a polypeptide having the sequence VNIFLCLGMSQKK (SEQ ID NO:421) corresponding to amino acids 185-197 of Z36249_PEA_3_P3 (SEQ ID NO:314), wherein said first amino acid sequence, bridging amino acid, second amino acid sequence and third amino acid sequence are contiguous and in a sequential order.

2. An isolated polypeptide encoding for a tail of Z36249_PEA_3_P3 (SEQ ID NO:314), comprising a polypeptide being at least 70%, optionally at least about 80%, preferably at least about 85%, more preferably at least about 90% and most preferably at least about 95% homologous to the sequence VNIFLCLGMSQKK (SEQ ID NO:421) in Z36249_PEA_3_P3 (SEQ ID NO:314).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein Z36249_PEA_3_P3 (SEQ ID NO:314) also has the following non-silent SNPs (Single Nucleotide Polymorphisms) as listed in Table 6, (given according to their position(s) on the amino acid sequence, with the alternative amino acid(s) listed; the last column indicates whether the SNP is known or not; the presence of known SNPs in variant protein Z36249_PEA_3_P3 (SEQ ID NO:314) sequence provides support for the deduced sequence of this variant protein according to the present invention).

TABLE 6

Amino acid mutations

| SNP position(s) on amino acid sequence | Alternative amino acid(s) | Previously known SNP? |
|---|---|---|
| 34 | E -> * | Yes |

Variant protein Z36249_PEA_3_P3 (SEQ ID NO:314) is encoded by the following transcript(s): Z36249_PEA_3_T3 (SEQ ID NO:39), for which the sequence(s) is/are given at the end of the application. The coding portion of transcript Z36249_PEA_3_T3 (SEQ ID NO:39) is shown in bold; this coding portion starts at position 250 and ends at position 840. The transcript also has the following SNPs as listed in Table 7 (given according to their position on the nucleotide sequence, with the alternative nucleic acid listed; the last column indicates whether the SNP is known or not; the presence of known SNPs in variant protein Z36249_PEA_3_P3 (SEQ ID NO:314) sequence provides support for the deduced sequence of this variant protein according to the present invention).

TABLE 7

Nucleic acid SNPs

| SNP position on nucleotide sequence | Alternative nucleic acid | Previously known SNP? |
|---|---|---|
| 105 | T -> C | Yes |
| 208 | T -> | No |
| 349 | G -> T | Yes |
| 459 | C -> A | No |

Variant protein Z36249_PEA_3_P4 (SEQ ID NO:315) according to the present invention has an amino acid sequence as given at the end of the application; it is encoded by transcript(s) Z36249_PEA_3_T5 (SEQ ID NO:40). One or more alignments to one or more previously published protein sequences are given at the end of the application. A brief description of the relationship of the variant protein according to the present invention to each such aligned protein is as follows:

Comparison report between Z36249_PEA_3_P4 (SEQ ID NO:315) and Q96LE7 (SEQ ID NO:344):

1. An isolated chimeric polypeptide encoding for Z36249_PEA_3_P4 (SEQ ID NO:315), comprising a first amino acid sequence being at least 90% homologous to MMVLKVEELVTGKKNGNGEAGEFLPED-FRDGEYEAAVTLEKQEDLKTLLAHPVTLGE QQWK-SEKQREAELKKKKLEQRSKLEN-LEDLEIIIQLKKRKKYRKTKVPVVKEPEPEIITE PVDVPTFLKAALENKLPVVEKFLSDKNNPDVCDE corresponding to amino acids 1-151 of Q96LE7 (SEQ ID NO:344), which also corresponds to amino acids 1-151 of Z36249_PEA_3_P4 (SEQ ID NO:315), and a second amino acid sequence being at least 70%, optionally at least 80%, preferably at least 85%, more preferably at least 90% and most preferably at least 95% homologous to a polypeptide having the sequence VRLMQSTAKSSSLILCFLCFTPV-LLI (SEQ ID NO:422) corresponding to amino acids 152-177 of Z36249_PEA_3_P4 (SEQ ID NO:315), wherein said first amino acid sequence and second amino acid sequence are contiguous and in a sequential order.

2. An isolated polypeptide encoding for a tail of Z36249_PEA_3_P4 (SEQ ID NO:315), comprising a polypeptide being at least 70%, optionally at least about 80%, preferably at least about 85%, more preferably at least about 90% and most preferably at least about 95% homologous to the sequence VRLMQSTAKSSSLILCFLCFTPV-LLI (SEQ ID NO:422) in Z36249_PEA_3_P4 (SEQ ID NO:315).

Comparison report between Z36249_PEA_3_P4 (SEQ ID NO:315) and Q15327 (SEQ ID NO:345):

1. An isolated chimeric polypeptide encoding for Z36249_PEA_3_P4 (SEQ ID NO:315), comprising a first amino acid sequence being at least 90% homologous to MMVLKVEELVTGKKNGNGEAGEFLPED-FRDGEYEAAVTLEKQEDLKTLLAHPVTLGE QQWK-SEKQREAEL corresponding to amino acids 1-70 of Q15327 (SEQ ID NO:345), which also corresponds to amino acids 1-70 of Z36249_PEA_3_P4 (SEQ ID NO:315), a bridging amino acid K corresponding to amino acid 71 of Z36249_PEA_3_P4 (SEQ ID NO:315), a second amino acid sequence being at least 90% homologous to KKKLEQRSKLENLEDLEII-IQLKKRKKYRKTKVPVVKEPEPEI-ITEPVDVPTFLKAALENK LPVVEKFLSDKNNPD-VCDE corresponding to amino acids 72-151 of Q15327 (SEQ ID NO:345), which also corresponds to amino acids 72-151 of Z36249_PEA_3_P4 (SEQ ID NO:315), and a third amino acid sequence being at least 70%, optionally at least 80%, preferably at least 85%, more preferably at least 90% and most preferably at least 95% homologous to a polypeptide having the sequence VRLMQSTAKSSSLIL-CFLCFTPVLLI (SEQ ID NO:422) corresponding to amino acids 152-177 of Z36249_PEA_3_P4 (SEQ ID NO:315), wherein said first amino acid sequence, bridging amino acid, second amino acid sequence and third amino acid sequence are contiguous and in a sequential order.

2. An isolated polypeptide encoding for a tail of Z36249_PEA_3_P4 (SEQ ID NO:315), comprising a polypeptide being at least 70%, optionally at least about 80%, preferably at least about 85%, more preferably at least about 90% and most preferably at least about 95% homologous to the sequence VRLMQSTAKSSSLILCFLCFTPV-LLI (SEQ ID NO:422) in Z36249_PEA_3_P4 (SEQ ID NO:315).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because only one of the two trans-membrane region prediction programs (Tmpred: 1, Tmhmm: 0) has predicted that this protein has a trans-membrane region. In addition both signal-peptide prediction programs predict that this protein is a non-secreted protein.

Variant protein Z36249_PEA_3_P4 (SEQ ID NO:315) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein Z36249_PEA_3_P4 (SEQ ID NO:315) sequence provides support for the deduced sequence of this variant protein according to the present invention).

TABLE 8

Amino acid mutations

| SNP position(s) on amino acid sequence | Alternative amino acid(s) | Previously known SNP? |
|---|---|---|
| 34 | E -> * | Yes |

Variant protein Z36249_PEA_3_P4 (SEQ ID NO:315) is encoded by the following transcript(s): Z36249_PEA_3_T5 (SEQ ID NO:40), for which the sequence(s) is/are given at the end of the application. The coding portion of transcript Z36249_PEA_3_T5 (SEQ ID NO:40) is shown in bold; this coding portion starts at position 250 and ends at position 780. The transcript also has the following SNPs as listed in Table 9 (given according to their position on the nucleotide sequence, with the alternative nucleic acid listed; the last column indicates whether the SNP is known or not; the presence of known SNPs in variant protein Z36249_PEA_3_P4 (SEQ ID NO:315) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 105 | T -> C | Yes |
| 208 | T -> | No |
| 349 | G -> T | Yes |
| 459 | C -> A | No |
| 1265 | T -> C | Yes |

Variant protein Z36249_PEA_3_P5 (SEQ ID NO:316) according to the present invention has an amino acid sequence as given at the end of the application; it is encoded by transcript(s) Z36249_PEA_3_T9 (SEQ ID NO:41). One or more alignments to one or more previously published protein sequences are given at the end of the application. A brief description of the relationship of the variant protein according to the present invention to each such aligned protein is as follows:

Comparison report between Z36249_PEA_3_P5 (SEQ ID NO:316) and Q96LE7 (SEQ ID NO:344):

1. An isolated chimeric polypeptide encoding for Z36249_PEA_3_P5 (SEQ ID NO:316), comprising a first amino acid sequence being at least 90% homologous to MMVLKVEELVTGKKNGNGEAGEFLPED-FRDGEYEAAVTLEKQEDLKTLLAHPVTLGE QQWK-SEKQREAELKKKKLEQRSKLEN-LEDLEIIIQLKKRKKYRKTKVPVVKEPEPEIITE PVDVPTFLKAALENKLPVVEKFLSDKNNPDVCDE corresponding to amino acids 1-151 of Q96LE7 (SEQ ID NO:344), which also corresponds to amino acids 1-151 of Z36249_PEA_3_P5 (SEQ ID NO:316), and a second amino acid sequence being at least 90% homologous to LESTAIH-WASRGGNLDVLKLLLNKGAKISARDKLL-STALHVAVRTGHYECAEHLIACE ADLNAKDREGDT-PLHDAVRLNRYKMIRLLIMYGADLNIKNCAGKTPMD LVLHWQNG TKAIFDSLRENSYKTSRIATF corresponding to amino acids 185-319 of Q96LE7 (SEQ ID NO:344), which also corresponds to amino acids 152-286 of Z36249_PEA_3_P5 (SEQ ID NO:316), wherein said first amino acid sequence and second amino acid sequence are contiguous and in a sequential order.

2. An isolated chimeric polypeptide encoding for an edge portion of Z36249_PEA_3_P5 (SEQ ID NO:316), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EL, having a structure as follows: a sequence starting from any of amino acid numbers 151–x to 151; and ending at any of amino acid numbers 152+((n−2)−x), in which x varies from 0 to n−2.

Comparison report between Z36249_PEA_3_P5 (SEQ ID NO:316) and Q15327 (SEQ ID NO:345):

1. An isolated chimeric polypeptide encoding for Z36249_PEA_3_P5 (SEQ ID NO:316), comprising a first amino acid sequence being at least 90% homologous to MMVLKVEELVTGKKNGNGEAGEFLPED-FRDGEYEAAVTLEKQEDLKTLLAHPVTLGE QQWK-SEKQREAEL corresponding to amino acids 1-70 of Q15327 (SEQ ID NO:345), which also corresponds to amino acids 1-70 of Z36249_PEA_3_P5 (SEQ ID NO:316), a bridging amino acid K corresponding to amino acid 71 of Z36249_PEA_3_P5 (SEQ ID NO:316), a second amino acid sequence being at least 90% homologous to KKKLEQRSKLENLEDLEII-IQLKKRKKYRKTKVPVVKEPEPEI-ITEPVDVPTFLKAALENK LPVVEKFLSDKNNPD-VCDE corresponding to amino acids 72-151 of Q15327 (SEQ ID NO:345), which also corresponds to amino acids 72-151 of Z36249_PEA_3_P5 (SEQ ID NO:316), and a third amino acid sequence being at least 90% homologous to BESTAIHWASRGGNLDVLKLLLNKGAK-ISARDKLLSTALHVAVRTGHYECAEHLIACE ADL-NAKDREGDTPLHDAVRLNRYK-MIRLLIMYGADLNIKNCAGKTPMDLVLHWQNG TKAIFDSLRENSYKTSRIATF corresponding to amino acids 185-319 of Q15327 (SEQ ID NO:345), which also corresponds to amino acids 152-286 of Z36249_PEA_3_P5 (SEQ ID NO:316), wherein said first amino acid sequence, bridging amino acid, second amino acid sequence and third amino acid sequence are contiguous and in a sequential order.

2. An isolated chimeric polypeptide encoding for an edge portion of Z36249_PEA_3_P5 (SEQ ID NO:316), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EL, having a structure as follows: a sequence starting from any of amino acid numbers 151−x to 151; and ending at any of amino acid numbers 152+((n−2)−x), in which x varies from 0 to n−2.

The location of the variant protein was determined according to results from a number of different software programs and analyses, including analyses from SignalP and other specialized programs. The variant protein is believed to be located as follows with regard to the cell:

intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein Z36249_PEA_3_P5 (SEQ ID NO:316) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein Z36249_PEA_3_P5 (SEQ ID NO:316) sequence provides support for the deduced sequence of this variant protein according to the present invention).

TABLE 10

Amino acid mutations

| SNP position(s) on amino acid sequence | Alternative amino acid(s) | Previously known SNP? |
|---|---|---|
| 34 | E -> * | Yes |

Variant protein Z36249_PEA_3_P5 (SEQ ID NO:316) is encoded by the following transcript(s): Z36249_PEA_3_T9 (SEQ ID NO:41), for which the sequence(s) is/are given at the end of the application. The coding portion of transcript Z36249_PEA_3_T9 (SEQ ID NO:41) is shown in bold; this coding portion starts at position 250 and ends at position 1107. The transcript also has the following SNPs as listed in Table 11 (given according to their position on the nucleotide sequence, with the alternative nucleic acid listed; the last column indicates whether the SNP is known or not; the presence of known SNPs in variant protein Z36249_PEA_3_P5 (SEQ ID NO:316) sequence provides support for the deduced sequence of this variant protein according to the present invention).

TABLE 11

Nucleic acid SNPs

| SNP position on nucleotide sequence | Alternative nucleic acid | Previously known SNP? |
|---|---|---|
| 105 | T -> C | Yes |
| 208 | T -> | No |

TABLE 11-continued

Nucleic acid SNPs

| SNP position on nucleotide sequence | Alternative nucleic acid | Previously known SNP? |
|---|---|---|
| 349 | G -> T | Yes |
| 459 | C -> A | No |
| 1169 | A -> G | Yes |
| 1365 | C -> T | Yes |
| 1426 | C -> T | Yes |
| 1525 | C -> T | Yes |
| 1610 | C -> T | Yes |
| 1714 | G -> A | Yes |
| 1770 | G -> A | Yes |

As noted above, cluster Z36249 features 11 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z36249_PEA_3_node_0 (SEQ ID NO:186) according to the present invention is supported by 42 libraries. The number of libraries was determined as previously described. This segment can be found in the following transcript(s): Z36249_PEA_3_T2 (SEQ ID NO:38), Z36249_PEA_3_T3 (SEQ ID NO:39), Z36249_PEA_3_T5 (SEQ ID NO:40) and Z36249_PEA_3_T9 (SEQ ID NO:41). Table 12 below describes the starting and ending position of this segment on each transcript.

TABLE 12

Segment location on transcripts

| Transcript name | Segment starting position | Segment ending position |
|---|---|---|
| Z36249_PEA_3_T2 (SEQ ID NO: 38) | 1 | 276 |
| Z36249_PEA_3_T3 (SEQ ID NO: 39) | 1 | 276 |
| Z36249_PEA_3_T5 (SEQ ID NO: 40) | 1 | 276 |
| Z36249_PEA_3_T9 (SEQ ID NO: 41) | 1 | 276 |

Segment cluster Z36249_PEA_3_node_3 (SEQ ID NO:187) according to the present invention is supported by 45 libraries. The number of libraries was determined as previously described. This segment can be found in the following transcript(s): Z36249_PEA_3_T2 (SEQ ID NO:38), Z36249_PEA_3_T3 (SEQ ID NO:39), Z36249_PEA_3_T5 (SEQ ID NO:40) and Z36249_PEA_3_T9 (SEQ ID NO:41). Table 13 below describes the starting and ending position of this segment on each transcript.

TABLE 13

Segment location on transcripts

| Transcript name | Segment starting position | Segment ending position |
|---|---|---|
| Z36249_PEA_3_T2 (SEQ ID NO: 38) | 277 | 456 |
| Z36249_PEA_3_T3 (SEQ ID NO: 39) | 277 | 456 |
| Z36249_PEA_3_T5 (SEQ ID NO: 40) | 277 | 456 |

TABLE 13-continued

Segment location on transcripts

| Transcript name | Segment starting position | Segment ending position |
|---|---|---|
| Z36249_PEA_3_T9 (SEQ ID NO: 41) | 277 | 456 |

Segment cluster Z36249_PEA_3_node_5 (SEQ ID NO:188) according to the present invention is supported by 34 libraries. The number of libraries was determined as previously described. This segment can be found in the following transcript(s): Z36249_PEA_3_T2 (SEQ ID NO:38), Z36249_PEA_3_T3 (SEQ ID NO:39), Z36249_PEA_3_T5 (SEQ ID NO:40) and Z36249_PEA_3_T9 (SEQ ID NO:41). Table 14 below describes the starting and ending position of this segment on each transcript.

TABLE 14

Segment location on transcripts

| Transcript name | Segment starting position | Segment ending position |
|---|---|---|
| Z36249_PEA_3_T2 (SEQ ID NO: 38) | 457 | 594 |
| Z36249_PEA_3_T3 (SEQ ID NO: 39) | 457 | 594 |
| Z36249_PEA_3_T5 (SEQ ID NO: 40) | 457 | 594 |
| Z36249_PEA_3_T9 (SEQ ID NO: 41) | 457 | 594 |

Segment cluster Z36249_PEA_3_node_11 (SEQ ID NO:189) according to the present invention is supported by 4 libraries. The number of libraries was determined as previously described. This segment can be found in the following transcript(s): Z36249_PEA_3_T5 (SEQ ID NO:40). Table 15 below describes the starting and ending position of this segment on each transcript.

TABLE 15

Segment location on transcripts

| Transcript name | Segment starting position | Segment ending position |
|---|---|---|
| Z36249_PEA_3_T5 (SEQ ID NO: 40) | 703 | 1387 |

Segment cluster Z36249_PEA_3_node_14 (SEQ ID NO:190) according to the present invention is supported by 5 libraries. The number of libraries was determined as previously described. This segment can be found in the following transcript(s): Z36249_PEA_3_T3 (SEQ ID NO:39). Table 16 below describes the starting and ending position of this segment on each transcript.

TABLE 16

Segment location on transcripts

| Transcript name | Segment starting position | Segment ending position |
|---|---|---|
| Z36249_PEA_3_T3 (SEQ ID NO: 39) | 802 | 1472 |

Segment cluster Z36249_PEA_3_node_24 (SEQ ID NO:191) according to the present invention is supported by 34 libraries. The number of libraries was determined as previously described. This segment can be found in the following transcript(s): Z36249_PEA_3_T2 (SEQ ID NO:38) and Z36249_PEA_3_T9 (SEQ ID NO:41). Table 17 below describes the starting and ending position of this segment on each transcript.

TABLE 17

Segment location on transcripts

| Transcript name | Segment starting position | Segment ending position |
|---|---|---|
| Z36249_PEA_3_T2 (SEQ ID NO: 38) | 991 | 2064 |
| Z36249_PEA_3_T9 (SEQ ID NO: 41) | 1000 | 1877 |

According to an optional embodiment of the present invention, short segments related to the above cluster are also provided. These segments are up to about 120 bp in length, and so are included in a separate description.

Segment cluster Z36249_PEA_3_node_10 (SEQ ID NO:192) according to the present invention is supported by 30 libraries. The number of libraries was determined as previously described. This segment can be found in the following transcript(s): Z36249_PEA_3_T3 (SEQ ID NO:39), Z36249_PEA_3_T5 (SEQ ID NO:40) and Z36249_PEA_3_T9 (SEQ ID NO:41). Table 18 below describes the starting and ending position of this segment on each transcript.

TABLE 18

Segment location on transcripts

| Transcript name | Segment starting position | Segment ending position |
|---|---|---|
| Z36249_PEA_3_T3 (SEQ ID NO: 39) | 595 | 702 |
| Z36249_PEA_3_T5 (SEQ ID NO: 40) | 595 | 702 |
| Z36249_PEA_3_T9 (SEQ ID NO: 41) | 595 | 702 |

Segment cluster Z36249_PEA_3_node_13 (SEQ ID NO:193) according to the present invention is supported by 29 libraries. The number of libraries was determined as previously described. This segment can be found in the following transcript(s): Z36249_PEA_3_T2 (SEQ ID NO:38) and Z36249_PEA_3_T3 (SEQ ID NO:39). Table 19 below describes the starting and ending position of this segment on each transcript.

TABLE 19

Segment location on transcripts

| Transcript name | Segment starting position | Segment ending position |
|---|---|---|
| Z36249_PEA_3_T2 (SEQ ID NO: 38) | 595 | 693 |
| Z36249_PEA_3_T3 (SEQ ID NO: 39) | 703 | 801 |

Segment cluster Z36249_PEA_3_node_17 (SEQ ID NO:194) according to the present invention is supported by 26 libraries. The number of libraries was determined as previously described. This segment can be found in the following transcript(s): Z36249_PEA_3_T2 (SEQ ID NO:38) and Z36249_PEA_3_T9 (SEQ ID NO:41). Table 20 below describes the starting and ending position of this segment on each transcript.

TABLE 20

Segment location on transcripts

| Transcript name | Segment starting position | Segment ending position |
|---|---|---|
| Z36249_PEA_3_T2 (SEQ ID NO: 38) | 694 | 792 |
| Z36249_PEA_3_T9 (SEQ ID NO: 41) | 703 | 801 |

Segment cluster Z36249_PEA_3_node_19 (SEQ ID NO:195) according to the present invention is supported by 24 libraries. The number of libraries was determined as previously described. This segment can be found in the following transcript(s): Z36249_PEA_3_T2 (SEQ ID NO:38) and Z36249_PEA_3_T9 (SEQ ID NO:41). Table 21 below describes the starting and ending position of this segment on each transcript.

TABLE 21

Segment location on transcripts

| Transcript name | Segment starting position | Segment ending position |
|---|---|---|
| Z36249_PEA_3_T2 (SEQ ID NO: 38) | 793 | 891 |
| Z36249_PEA_3_T9 (SEQ ID NO: 41) | 802 | 900 |

Segment cluster Z36249_PEA_3_node_21 (SEQ ID NO:196) according to the present invention is supported by 18 libraries. The number of libraries was determined as previously described. This segment can be found in the following transcript(s): Z36249_PEA_3_T2 (SEQ ID NO:38) and Z36249_PEA_3_T9 (SEQ ID NO:41). Table 22 below describes the starting and ending position of this segment on each transcript.

TABLE 22

Segment location on transcripts

| Transcript name | Segment starting position | Segment ending position |
|---|---|---|
| Z36249_PEA_3_T2 (SEQ ID NO: 38) | 892 | 990 |
| Z36249_PEA_3_T9 (SEQ ID NO: 41) | 901 | 999 |

Variant Protein Alignment to the Previously Known Protein:
Sequence name: Q96LE7 (SEQ ID NO:344)
Sequence documentation:
Alignment of: Z36249_PEA3_P2 (SEQ ID NO:313)+ Q96LE7 (SEQ ID NO:344).

| Alignment segment 1/1: | | | |
|---|---|---|---|
| Quality: | 2639.00 | Escore: | 0 |
| Matching length: | 283 | Total length: | 319 |
| Matching Percent Similarity: | 100.00 | Matching Percent Identity: | 100.00 |
| Total Percent Similarity: | 88.71 | Total Percent Identity: | 88.71 |
| Gaps: | 1 | | |

Alignment:

```
  1  MMVLKVEELVTGKKNGNGEAGEFLPEDFRDGEYEAAVTLEKQEDLKTLLA   50
     |||||||||||||||||||||||||||||||||||||||||||||||||
  1  MMVLKVEELVTGKKNGNGEAGEFLPEDFRDGEYEAAVTLEKQEDLKTLLA   50

51  HPVTLGEQQWKSEKQREAELKKKKLEQRSKLENLEDLEIIIQLKKRKKYR  100
     |||||||||||||||||||||||||||||||||||||||||||||||||
 51  HPVTLGEQQWKSEKQREAELKKKKLEQRSKLENLEDLEIIIQLKKRKKYR  100

101  KTKVPVVKEPEPEII..................................  115
     |||||||||||||||
101  KTKVPVVKEPEPEIITEPVDVPTFLKAALENKLPVVEKFLSDKNNPDVCD  150

116  .YKRTALHRACLEGHLAIVEKLMEAGAQIEFRDMLESTAIHWASRGGNLD  164
      ||||||||||||||||||||||||||||||||||||||||||||||||
151  EYKRTALHRACLEGHLAIVEKLMEAGAQIEFRDMLESTAIHWASRGGNLD  200

165  VLKLLLNKGAKISARDKLLSTALHVAVRTGHYECAEHLIACEADLNAKDR  214
     |||||||||||||||||||||||||||||||||||||||||||||||||
201  VLKLLLNKGAKISARDKLLSTALHVAVRTGHYECAEHLIACEADLNAKDR  250

215  EGDTPLHDAVRLNRYKMIRLLIMYGADLNIKNCAGKTPMDLVLHWQNGTK  264
     |||||||||||||||||||||||||||||||||||||||||||||||||
251  EGDTPLHDAVRLNRYKMIRLLIMYGADLNIKNCAGKTPMDLVLHWQNGTK  300

265  AIFDSLRENSYKTSRIATF                                283
     |||||||||||||||||||
301  AIFDSLRENSYKTSRIATF                                319
```

Sequence name: Q15327 (SEQ ID NO:345)

Sequence documentation:

Alignment of: Z36249_PEA_3_P2 (SEQ ID NO:313)+ Q15327 (SEQ ID NO:345).

| Alignment segment 1/1: | | | |
|---|---|---|---|
| Quality: | 2626.00 | Escore: | 0 |
| Matching length: | 283 | Total length: | 319 |

| -continued | | | |
|---|---|---|---|
| Alignment segment 1/1: | | | |
| Matching Percent Similarity: | 99.65 | Matching Percent Identity: | 99.65 |
| Total Percent Similarity: | 88.40 | Total Percent Identity: | 88.40 |
| Gaps: | 1 | | |

Alignment:

```
  1 MMVLKVEELVTGKKNGNGEAGEFLPEDFRDGEYEAAVTLEKQEDLKTLLA   50
    |||||||||||||||||||||||||||||||||||||||||||||||||
  1 MMVLKVEELVTGKKNGNGEAGEFLPEDFRDGEYEAAVTLEKQEDLKTLLA   50

51 HPVTLGEQQWKSEKQREAELKKKKLEQRSKLENLEDLEIIIQLKKRKKYR  100
    ||||||||||||||||||||||| |||||||||||||||||||||||||
 51 HPVTLGEQQWKSEKQREAELPKKKLEQRSKLENLEDLEIIIQLKKRKKYR  100

101 KTKVPVVKEPEPEII..................................  115
    |||||||||||||||
101 KTKVPVVKEPEPEIITEPVDVPTFLKAALENKLPVVEKFLSDKNNPDVCD  150

116 .YKRTALHRACLEGHLAIVEKLMEAGAQIEFRDMLESTAIHWASRGGNLD  164
     ||||||||||||||||||||||||||||||||||||||||||||||||
151 EYKRTALHRACLEGHLAIVEKLMEAGAQIEFRDMLESTAIHWASRGGNLD  200

165 VLKLLLNKGAKISARDKLLSTALHVAVRTGHYECAEHLIACEADLNAKDR  214
    |||||||||||||||||||||||||||||||||||||||||||||||||
201 VLKLLLNKGAKISARDKLLSTALHVAVRTGHYECAEHLIACEADLNAKDR  250

215 EGDTPLHDAVRLNRYKMIRLLIMYGADLNIKNCAGKTPMDLVLHWQNGTK  264
    |||||||||||||||||||||||||||||||||||||||||||||||||
251 EGDTPLHDAVRLNRYKMIRLLIMYGADLNIKNCAGKTPMDLVLHWQNGTK  300

265 AIFDSLRENSYKTSRIATF                                283
    |||||||||||||||||||
301 AIFDSLRENSYKTSRIATF                                319
```

Sequence name: Q96LE7 (SEQ ID NO:344)

Sequence documentation:

Alignment of: Z36249_PEA_3_P3 (SEQ ID NO:344)+ Q96LE7 (SEQ ID NO:344).

| Alignment segment 1/1: | | | |
|---|---|---|---|
| Quality: | 1785.00 | Escore: | 0 |
| Matching length: | 184 | Total length: | 184 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MMVLKVEELVTGKKNGNGEAGEFLPEDFRDGEYEAAVTLEKQEDLKTLLA   50
     ||||||||||||||||||||||||||||||||||||||||||||||||||
  1  MMVLKVEELVTGKKNGNGEAGEFLPEDFRDGEYEAAVTLEKQEDLKTLLA   50

51  HPVTLGEQQWKSEKQREAELKKKKLEQRSKLENLEDLEIIIQLKKRKKYR  100
     |||||||||||||||||||||||||||||||||||||||||||||||||
 51  HPVTLGEQQWKSEKQREAELKKKKLEQRSKLENLEDLEIIIQLKKRKKYR  100

101  KTKVPVVKEPEPEIITEPVDVPTFLKAALENKLPVVEKFLSDKNNPDVCD  150
     |||||||||||||||||||||||||||||||||||||||||||||||||
101  KTKVPVVKEPEPEIITEPVDVPTFLKAALENKLPVVEKFLSDKNNPDVCD  150

151  EYKRTALHRACLEGHLAIVEKLMEAGAQIEFRDM  184
     |||||||||||||||||||||||||||||||||
151  EYKRTALHRACLEGHLAIVEKLMEAGAQIEFRDM  184
```

Sequence name: Q15327 (SEQ ID NO:345)
Sequence documentation:
Alignment of: Z35249_PEA_3_P3 (SEQ ID NO:314)+ Q15327 (SEQ ID NO:345).

| Alignment segment 1/1: | | | |
|---|---|---|---|
| Quality: | 1772.00 | Escore: | 0 |
| Matching length: | 184 | Total length: | 184 |
| Matching Percent Similarity: | 99.46 | Matching Percent Identity: | 99.46 |
| Total Percent Similarity: | 99.46 | Total Percent Identity: | 99.46 |
| Gaps: | 0 | | |

Alignment:

```
  1  MMVLKVEELVTGKKNGNGEAGEFLPEDFRDGEYEAAVTLEKQEDLKTLLA   50
     ||||||||||||||||||||||||||||||||||||||||||||||||||
  1  MMVLKVEELVTGKKNGNGEAGEFLPEDFRDGEYEAAVTLEKQEDLKTLLA   50

51  HPVTLGEQQWKSEKQREAELKKKKLEQRSKLENLEDLEIIIQLKKRKKYR  100
     ||||||||||||||||||||| ||||||||||||||||||||||||||
 51  HPVTLGEQQWKSEKQREAELPKKKLEQRSKLENLEDLEIIIQLKKRKKYR  100

101  KTKVPVVKEPEPEIITEPVDVPTFLKAALENKLPVVEKFLSDKNNPDVCD  150
     |||||||||||||||||||||||||||||||||||||||||||||||||
101  KTKVPVVKEPEPEIITEPVDVPTFLKAALENKLPVVEKFLSDKNNPDVCD  150

151  EYKRTALHRACLEGHLAIVEKLMEAGAQIEFRDM  184
     |||||||||||||||||||||||||||||||||
151  EYKRTALHRACLEGHLAIVEKLMEAGAQIEFRDM  184
```

Sequence name: Q96LE7 (SEQ ID NO:344)
Sequence documentation:
Alignment of: Z36249_PEA_3_P4 (SEQ ID NO:315)+ Q96LE7 (SEQ ID NO:344).

| Alignment segment 1/1: | | | |
|---|---|---|---|
| Quality: | 1464.00 | Escore: | 0 |
| Matching length: | 151 | Total length: | 151 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MMVLKVEELVTGKKNGNGEAGEFLPEDFRDGEYEAAVTLEKQEDLKTLLA   50
    |||||||||||||||||||||||||||||||||||||||||||||||||
  1 MMVLKVEELVTGKKNGNGEAGEFLPEDFRDGEYEAAVTLEKQEDLKTLLA   50

51 HPVTLGEQQWKSEKQREAELKKKKLEQRSKLENLEDLEIIIQLKKRKKYR  100
    |||||||||||||||||||||||||||||||||||||||||||||||||
 51 HPVTLGEQQWKSEKQREAELKKKKLEQRSKLENLEDLEIIIQLKKRKKYR  100

101 KTKVPVVKEPEPEIITEPVDVPTFLKAALENKLPVVEKFLSDKNNPDVCD  150
    |||||||||||||||||||||||||||||||||||||||||||||||||
101 KTKVPVVKEPEPEIITEPVDVPTFLKAALENKLPVVEKFLSDKNNPDVCD  150
151 E                                                  151
    |
151 E                                                  151
```

Sequence name: Q15327 (SEQ ID NO:345)

Sequence documentation:

Alignment of: Z36249_PEA_3_P4 (SEQ ID NO:315)+ Q15327 (SEQ ID NO:345).

| Alignment segment 1/1: | | | |
|---|---|---|---|
| Quality: | 1451.00 | Escore: | 0 |
| Matching length: | 151 | Total length: | 151 |
| Matching Percent Similarity: | 99.34 | Matching Percent Identity: | 99.34 |
| Total Percent Similarity: | 99.34 | Total Percent Identity: | 99.34 |
| Gaps: | 0 | | |

Alignment:

```
  1 MMVLKVEELVTGKKNGNGEAGEFLPEDFRDGEYEAAVTLEKQEDLKTLLA   50
    |||||||||||||||||||||||||||||||||||||||||||||||||
  1 MMVLKVEELVTGKKNGNGEAGEFLPEDFRDGEYEAAVTLEKQEDLKTLLA   50

51 HPVTLGEQQWKSEKQREAELKKKKLEQRSKLENLEDLEIIIQLKKRKKYR  100
    ||||||||||||||||||||| |||||||||||||||||||||||||||
 51 HPVTLGEQQWKSEKQREAELPKKKLEQRSKLENLEDLEIIIQLKKRKKYR  100

101 KTKVPVVKEPEPEIITEPVDVPTFLKAALENKLPVVEKFLSDKNNPDVCD  150
    |||||||||||||||||||||||||||||||||||||||||||||||||
101 KTKVPVVKEPEPEIITEPVDVPTFLKAALENKLPVVEKFLSDKNNPDVCD  150
151 E                                                  151
    |
151 E                                                  151
```

Sequence name: Q96LE7 (SEQ ID NO:344)

Sequence documentation:

Alignment of: Z36249_PEA_3_P5 (SEQ ID NO:316)+ Q96LE7 (SEQ ID NO:344).

| Alignment segment 1/1: | | | |
|---|---|---|---|
| Quality: | 2670.00 | Escore: | 0 |
| Matching length: | 286 | Total length: | 319 |
| Matching Percent Similarity: | 100.00 | Matching Percent Identity: | 100.00 |
| Total Percent Similarity: | 89.66 | Total Percent Identity: | 89.66 |
| Gaps: | 1 | | |

Alignment:

```
  1 MMVLKVEELVTGKKNGNGEAGEFLPEDFRDGEYEAAVTLEKQEDLKTLLA   50
    ||||||||||||||||||||||||||||||||||||||||||||||||||
  1 MMVLKVEELVTGKKNGNGEAGEFLPEDFRDGEYEAAVTLEKQEDLKTLLA   50

51 HPVTLGEQQWKSEKQREAELKKKKLEQRSKLENLEDLEIIIQLKKRKKYR  100
    |||||||||||||||||||||||||||||||||||||||||||||||||
 51 HPVTLGEQQWKSEKQREAELKKKKLEQRSKLENLEDLEIIIQLKKRKKYR  100

101 KTKVPVVKEPEPEIITEPVDVPTFLKAALENKLPVVEKFLSDKNNPDVCD  150
    |||||||||||||||||||||||||||||||||||||||||||||||||
101 KTKVPVVKEPEPEIITEPVDVPTFLKAALENKLPVVEKFLSDKNNPDVCD  150

151 E..............................LESTAIHWASRGGNLD    167
    |                              ||||||||||||||||
151 EYKRTALHRACLEGHLAIVEKLMEAGAQIEFRDMLESTAIHWASRGGNLD  200

168 VLKLLLNKGAKISARDKLLSTALHVAVRTGHYECAEHLIACEADLNAKDR  217
    |||||||||||||||||||||||||||||||||||||||||||||||||
201 VLKLLLNKGAKISARDKLLSTALHVAVRTGHYECAEHLIACEADLNAKDR  250

218 EGDTPLHDAVRLNRYKMIRLLIMYGADLNIKNCAGKTPMDLVLHWQNGTK  267
    |||||||||||||||||||||||||||||||||||||||||||||||||
251 EGDTPLHDAVRLNRYKMIRLLIMYGADLNIKNCAGKTPMDLVLHWQNGTK  300

268 AIFDSLRENSYKTSRIATF                                286
    |||||||||||||||||||
301 AIFDSLRENSYKTSRIATF                                319
```

Sequence name: Q15327 (SEQ ID NO:345)

Sequence documentation:

Alignment of: Z36249_PEA_3_P5 (SEQ ID NO:316)+ Q15327 (SEQ ID NO:345).

| Alignment segment 1/1: | | | |
|---|---|---|---|
| Quality: | 2657.00 | Escore: | 0 |
| Matching length: | 286 | Total length: | 319 |
| Matching Percent | 99.65 | Matching Percent Identity: | 99.65 |

| Alignment segment 1/1: | | | |
|---|---|---|---|
| Similarity: | | | |
| Total Percent Similarity: | 89.34 | Total Percent Identity: | 89.34 |
| Gaps: | 1 | | |

Alignment:

```
  1 MMVLKVEELVTGKKNGNGEAGEFLPEDFRDGEYEAAVTLEKQEDLKTLLA   50
    ||||||||||||||||||||||||||||||||||||||||||||||||||
  1 MMVLKVEELVTGKKNGNGEAGEFLPEDFRDGEYEAAVTLEKQEDLKTLLA   50

51 HPVTLGEQQWKSEKQREAELKKKKLEQRSKLENLEDLEIIIQLKKRKKYR  100
    ||||||||||||||||||||| |||||||||||||||||||||||||||
 51 HPVTLGEQQWKSEKQREAELPKKKLEQRSKLENLEDLEIIIQLKKRKKYR  100

101 KTKVPVVKEPEPEIITEPVDVPTFLKAALENKLPVVEKFLSDKNNPDVCD  150
    |||||||||||||||||||||||||||||||||||||||||||||||||
101 KTKVPVVKEPEPEIITEPVDVPTFLKAALENKLPVVEKFLSDKNNPDVCD  150

151 E..............................LESTAIHWASRGGNLD    167
    |                              ||||||||||||||||
151 EYKRTALHRACLEGHLAIVEKLMEAGAQIEFRDMLESTAIHWASRGGNLD  200

168 VLKLLLNKGAKISARDKLLSTALHVAVRTGHYECAEHLIACEADLNAKDR  217
    |||||||||||||||||||||||||||||||||||||||||||||||||
201 VLKLLLNKGAKISARDKLLSTALHVAVRTGHYECAEHLIACEADLNAKDR  250

218 EGDTPLHDAVRLNRYKMIRLLIMYGADLNIKNCAGKTPMDLVLHWQNGTK  267
    |||||||||||||||||||||||||||||||||||||||||||||||||
251 EGDTPLHDAVRLNRYKMIRLLIMYGADLNIKNCAGKTPMDLVLHWQNGTK  300

268 AIFDSLRENSYKTSRIATF                                286
    |||||||||||||||||||
301 AIFDSLRENSYKTSRIATF                                319
```

Description for Cluster Z25377

Cluster Z25377 features 9 transcript(s) and 12 segment(s) of interest, the names for which are given in Tables 1 and 2, respectively, the sequences themselves are given at the end of the application. The selected protein variants are given in table 3.

TABLE 1

Transcripts of interest

| Transcript Name | Seq ID No. |
|---|---|
| Z25377_PEA_1_T1 | 42 |
| Z25377_PEA_1_T5 | 43 |
| Z25377_PEA_1_T7 | 44 |
| Z25377_PEA_1_T8 | 45 |
| Z25377_PEA_1_T9 | 46 |
| Z25377_PEA_1_T10 | 47 |
| Z25377_PEA_1_T11 | 48 |
| Z25377_PEA_1_T12 | 49 |
| Z25377_PEA_1_T13 | 50 |

TABLE 2

Segments of interest

| Segment Name | Seq ID No. |
|---|---|
| Z25377_PEA_1_node_5 | 197 |
| Z25377_PEA_1_node_12 | 198 |
| Z25377_PEA_1_node_15 | 199 |
| Z25377_PEA_1_node_17 | 200 |
| Z25377_PEA_1_node_18 | 201 |
| Z25377_PEA_1_node_22 | 202 |
| Z25377_PEA_1_node_24 | 203 |
| Z25377_PEA_1_node_0 | 204 |
| Z25377_PEA_1_node_7 | 205 |
| Z25377_PEA_1_node_8 | 206 |
| Z25377_PEA_1_node_10 | 207 |
| Z25377_PEA_1_node_20 | 208 |

TABLE 3

Proteins of interest

| Protein Name | Seq ID No. | Corresponding Transcript(s) |
|---|---|---|
| Z25377_PEA_1_P12 | 317 | Z25377_PEA_1_T11 (SEQ ID NO: 48) |
| Z25377_PEA_1_P13 | 318 | Z25377_PEA_1_T12 (SEQ ID NO: 49) |
| Z25377_PEA_1_P14 | 319 | Z25377_PEA_1_T13 (SEQ ID NO: 50) |
| Z25377_PEA_1_P15 | 320 | Z25377_PEA_1_T1 (SEQ ID NO: 42) |
| Z25377_PEA_1_P17 | 321 | Z25377_PEA_1_T5 (SEQ ID NO: 43) |
| Z25377_PEA_1_P18 | 322 | Z25377_PEA_1_T7 (SEQ ID NO: 44) |
| Z25377_PEA_1_P19 | 323 | Z25377_PEA_1_T8 (SEQ ID NO: 45) |
| Z25377_PEA_1_P20 | 324 | Z25377_PEA_1_T9 (SEQ ID NO: 46) |
| Z25377_PEA_1_P21 | 325 | Z25377_PEA_1_T10 (SEQ ID NO: 47) |

These sequences are variants of the known protein Hypothetical protein FLJ26352 (SEQ ID NO:390) (SwissProt accession identifier Q6ZP80; known also according to the synonyms RLN16974), referred to herein as the previously known protein.

The sequence for protein Hypothetical protein FLJ26352 is given at the end of the application, as "Hypothetical protein FLJ26352 amino acid sequence" (SEQ ID NO:390).

The heart-selective diagnostic marker prediction engine provided the following results with regard to cluster Z25377. Predictions were made for selective expression of transcripts of this cluster in heart tissue, according to the previously described methods. The numbers on the y-axis of FIG. 29 refer to weighted expression of ESTs in each category, as "parts per million" (ratio of the expression of ESTs for a particular cluster to the expression of all ESTs in that category, according to parts per million).

Figure 29:
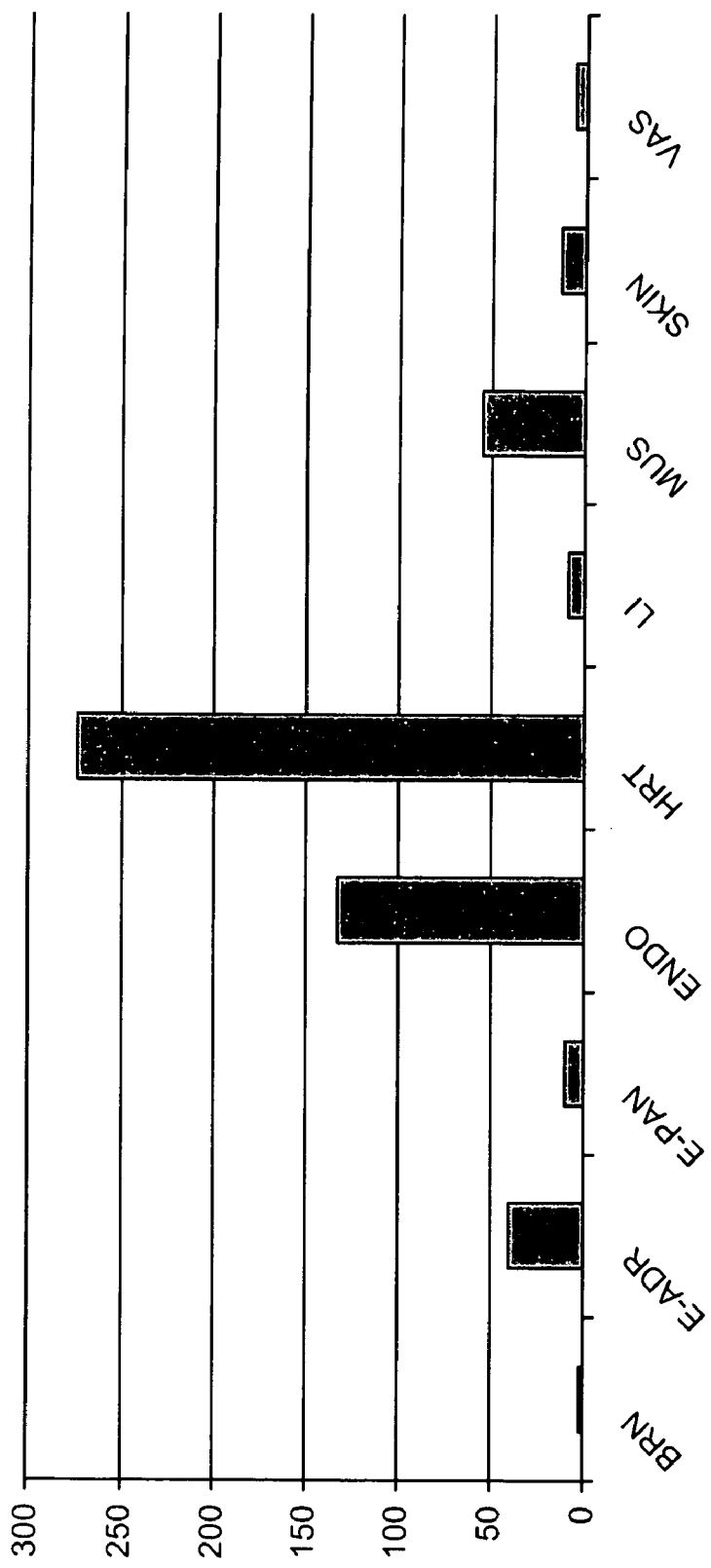
FIG. 29 is a histogram concerning expression of ESTs in the number of heart tissue-specific clones in libraries/sequences.

Overall, the following results were obtained as shown with regard to the histogram in FIG. 29, concerning the number of heart-specific clones in libraries/sequences.

This cluster was found to be selectively expressed in heart for the following reasons: in a comparison of the ratio of expression of the cluster in heart specific ESTs to the overall expression of the cluster in non-heart ESTs, which was found to be 13.3; the ratio of expression of the cluster in heart specific ESTs to the overall expression of the cluster in muscle-specific ESTs which was found to be 4.9; and fisher exact test P-values were computed both for library and weighted clone counts to check that the counts are statistically significant, and were found to be 6.50E-07.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 13.3, which clearly supports specific expression in heart tissue.

As noted above, cluster Z25377 features 9 transcript(s), which were listed in Table 1 above. These transcript(s) encode for protein(s) which are variant(s) of protein Hypothetical protein FLJ26352 (SEQ ID NO:390). A description of each variant protein according to the present invention is now provided.

Variant protein Z25377_PEA_1_P12 (SEQ ID NO:317) according to the present invention has an amino acid sequence as given at the end of the application; it is encoded by transcript(s) Z25377_PEA_1_T11 (SEQ ID NO:48). An alignment is given to the known protein (Hypothetical protein FLJ26352 (SEQ ID NO:390)) at the end of the application. One or more alignments to one or more previously published protein sequences are given at the end of the application. A brief description of the relationship of the variant protein according to the present invention to each such aligned protein is as follows:

Comparison report between Z25377_PEA_1_P12 (SEQ ID NO:317) and BAC85244 (SEQ ID NO:341):

1. An isolated chimeric polypeptide encoding for Z25377_PEA_1_P12 (SEQ ID NO:317), comprising a first amino acid sequence being at least 90% homologous to MRLNIAIFFGALFGALGVLLFLVAFGS-DYWLLATEVGRCSGEKNIENVTFHHEGFFWRC WFNGIVEENDSNIWKFWYT-NQPPSKNCTHAYLSPYPFMRGEHNSTSYDSAVIYRG FWA VLMLLGVVAVVIASFLIICAAPFASH-FLYKAGGGSYIAAGI corresponding to amino acids 1-158 of BAC85244 (SEQ ID NO:341), which also corresponds to amino acids 1-158 of Z25377_PEA_1_P12 (SEQ ID NO:317).

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein Z25377_PEA_1_P12 (SEQ ID NO:317) also has the following non-silent SNPs (Single Nucleotide Polymorphisms) as listed in Table 4, (given according to their position(s) on the amino acid sequence, with the alternative amino acid(s) listed; the last column indicates whether the SNP is known or not; the presence of known SNPs in variant protein Z25377_PEA_1_P12 (SEQ ID NO:317) sequence provides support for the deduced sequence of this variant protein according to the present invention).

TABLE 4

Amino acid mutations

| SNP position(s) on amino acid sequence | Alternative amino acid(s) | Previously known SNP? |
|---|---|---|
| 157 | G -> E | No |

Variant protein Z25377_PEA_1_P12 (SEQ ID NO:317) is encoded by the following transcript(s): Z25377_PEA_1_T11 (SEQ ID NO:48), for which the sequence(s) is/are given at the end of the application. The coding portion of transcript Z25377_PEA_1_T11 (SEQ ID NO:48) is shown in bold; this coding portion starts at position 188 and ends at position 661. The transcript also has the following SNPs as listed in Table 5 (given according to their position on the nucleotide sequence, with the alternative nucleic acid listed; the last column indicates whether the SNP is known or not; the presence of known SNPs in variant protein Z25377_PEA_1_P12 (SEQ ID NO:317) sequence provides support for the deduced sequence of this variant protein according to the present invention).

TABLE 5

Nucleic acid SNPs

| SNP position on nucleotide sequence | Alternative nucleic acid | Previously known SNP? |
|---|---|---|
| 71 | T -> C | Yes |
| 99 | T -> | Yes |
| 657 | G -> A | No |
| 933 | T -> | No |
| 935 | T -> A | No |

Variant protein Z25377_PEA_1_P13 (SEQ ID NO:318) according to the present invention has an amino acid sequence as given at the end of the application; it is encoded by transcript(s) Z25377_PEA_1_T12 (SEQ ID NO:49). An alignment is given to the known protein (Hypothetical protein FLJ26352 (SEQ ID NO:390)) at the end of the application. One or more alignments to one or more previously published protein sequences are given at the end of the application. A brief description of the relationship of the variant protein according to the present invention to each such aligned protein is as follows:

Comparison report between Z25377_PEA_1_P13 (SEQ ID NO:318) and BAC85244 (SEQ ID NO:341):

1. An isolated chimeric polypeptide encoding for Z25377_PEA_1_P13 (SEQ ID NO:318), comprising a first amino acid sequence being at least 90% homologous to MRLNIAIFFGALFGALGVLLFLVAFGS-DYWLLATEVGRCSGEKNIENVTFHHEGFFWRC WFNGIVEENDSNIWKFWYT-NQPPSKNCTHAYLSPYPFMRGEHNSTSYDSAVIYRGF WA VLMLLGVVAVVIASFLIICAAPFASH-FLYKAGGGSYIAA corresponding to amino acids 1-156 of BAC85244 (SEQ ID NO:341), which also corresponds to amino acids 1-156 of Z25377_PEA_1_P13 (SEQ ID NO:318), and a second amino acid sequence being at least 70%, optionally at least 80%, preferably at least 85%, more preferably at least 90% and most preferably at least 95% homologous to a polypeptide having the sequence VSVGQECGSG (SEQ ID NO:423) corresponding to amino acids 157-166 of Z25377_PEA_1_P13 (SEQ ID NO:318), wherein said first amino acid sequence and second amino acid sequence are contiguous and in a sequential order.

2. An isolated polypeptide encoding for a tail of Z25377_PEA_1_13 P13 (SEQ ID NO:318), comprising a polypeptide being at least 70%, optionally at least about 80%, preferably at least about 85%, more preferably at least about 90% and most preferably at least about 95% homologous to the sequence VSVGQECGSG (SEQ ID NO:423) in Z25377_PEA_1_P13 (SEQ ID NO:318).

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein Z25377_PEA_1_P13 (SEQ ID NO:318) is encoded by the following transcript(s): Z25377_PEA_1_T12 (SEQ ID NO:49), for which the sequence(s) is/are given at the end of the application. The coding portion of transcript Z25377_PEA_1_T12 (SEQ ID NO:49) is shown in bold; this coding portion starts at position 188 and ends at position 685. The transcript also has the following SNPs as listed in Table 6 (given according to their position on the nucleotide sequence, with the alternative nucleic acid listed; the last column indicates whether the SNP is known or not; the presence of known SNPs in variant protein Z25377_PEA_1_P13 (SEQ ID NO:318) sequence provides support for the deduced sequence of this variant protein according to the present invention).

TABLE 6

Nucleic acid SNPs

| SNP position on nucleotide sequence | Alternative nucleic acid | Previously known SNP? |
|---|---|---|
| 71 | T -> C | Yes |
| 99 | T -> | Yes |

Variant protein Z25377_PEA_1_P14 (SEQ ID NO:319) according to the present invention has an amino acid sequence as given at the end of the application; it is encoded by transcript(s) Z25377_PEA_1_T13 (SEQ ID NO:50). An alignment is given to the known protein (Hypothetical protein FLJ26352 (SEQ ID NO:390)) at the end of the application. One or more alignments to one or more previously published protein sequences are given at the end of the application. A brief description of the relationship of the variant protein according to the present invention to each such aligned protein is as follows:

Comparison report between Z25377_PEA_1_P14 (SEQ ID NO:319) and BAC85244 (SEQ ID NO:341):

1. An isolated chimeric polypeptide encoding for Z25377_PEA_1_P14 (SEQ ID NO:319), comprising a first amino acid sequence being at least 90% homologous to MRLNIAIFFGALFGALGVLLFLVAFGS-DYWLLATEVGRCSGEKNIENVTFHHEGFFWRC WFN-GIVEENDSNIWKFWYT-NQPPSKNCTHAYLSPYPFMRGEHNSTSYDSAVIYRGFWA VLMLLGVVAVVIASFLIICAAPFASH-FLYKAGGGSYIAA corresponding to amino acids 1-156 of BAC85244 (SEQ ID NO:341), which also corresponds to amino acids 1-156 of Z25377_PEA_1_P14 (SEQ ID NO:319), and a second amino acid sequence being at least 70%, optionally at least 80%, preferably at least 85%, more preferably at least 90% and most preferably at least 95% homologous to a polypeptide having the sequence DGISS-LCYSSLSKSLLSQPLRETSSAINDIS-LLQALMPLLGWTSHWTCITVGLY (SEQ ID NO:424) corresponding to amino acids 157-210 of Z25377_PEA_1_P14 (SEQ ID NO:319), wherein said first amino acid sequence and second amino acid sequence are contiguous and in a sequential order.

2. An isolated polypeptide encoding for a tail of Z25377_PEA_1_P14 (SEQ ID NO:319), comprising a polypeptide being at least 70%, optionally at least about 80%, preferably at least about 85%, more preferably at least about 90% and most preferably at least about 95% homologous to the sequence DGISSLCYSSLSKSLLSQPLRETS-SAINDISLLQALMPLLGWTSHWTCITVGLY (SEQ ID NO:424) in Z25377_PEA_1_P14 (SEQ ID NO:319).

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein Z25377_PEA_1_P14 (SEQ ID NO:319) is encoded by the following transcript(s): Z25377_PEA_1_T13 (SEQ ID NO:50), for which the sequence(s) is/are given at the end of the application. The coding portion of transcript Z25377_PEA_1_T13 (SEQ ID NO:50) is shown in bold; this coding portion starts at position 188 and ends at position 817. The transcript also has the following SNPs as listed in Table 7 (given according to their position on the nucleotide sequence, with the alternative nucleic acid listed; the last column indicates whether the SNP is known or not; the presence of known SNPs in variant protein Z25377_PEA_1_P14 (SEQ ID NO:319) sequence provides support for the deduced sequence of this variant protein according to the present invention).

TABLE 7

Nucleic acid SNPs

| SNP position on nucleotide sequence | Alternative nucleic acid | Previously known SNP? |
|---|---|---|
| 71 | T -> C | Yes |
| 99 | T -> | Yes |
| 823 | T -> | No |
| 825 | T -> A | No |

Variant protein Z25377_PEA_1_P15 (SEQ ID NO:320) according to the present invention has an amino acid sequence as given at the end of the application; it is encoded by transcript(s) Z25377_PEA_1_T1 (SEQ ID NO:42). An alignment is given to the known protein (Hypothetical protein FLJ26352 (SEQ ID NO:390)) at the end of the application. One or more alignments to one or more previously published protein sequences are given at the end of the application. A brief description of the relationship of the variant protein according to the present invention to each such aligned protein is as follows:

Comparison report between Z25377_PEA_1_P15 (SEQ ID NO:320) and Q96NR4 (SEQ ID NO:342):

1. An isolated chimeric polypeptide encoding for Z25377_PEA_1_P15 (SEQ ID NO:320), comprising a first amino acid sequence being at least 90% homologous to MRGEHNSTSYDSAVIYRGFWAVLMLLGV-VAVVIASFLIICAAPFASHFLYKAGGGSYIA A corresponding to amino acids 1-60 of Q96NR4 (SEQ ID NO:342), which also corresponds to amino acids 1-60 of Z25377_PEA_1_P15 (SEQ ID NO:320), and a second amino acid sequence being at least 70%, optionally at least 80%, preferably at least 85%, more preferably at least 90% and most preferably at least 95% homologous to a polypeptide having the sequence DGISSLCYSSLSKSLLSQPL-RETSSAINDISLLQALMPLLGWTSHWTCITVGLY (SEQ ID NO:424) corresponding to amino acids 61-114 of Z25377_PEA_1_P15 (SEQ ID NO:320), wherein said first amino acid sequence and second amino acid sequence are contiguous and in a sequential order.

2. An isolated polypeptide encoding for a tail of Z25377_PEA_1_P15 (SEQ ID NO:320), comprising a polypeptide being at least 70%, optionally at least about 80%, preferably at least about 85%, more preferably at least about 90% and most preferably at least about 95% homologous to the sequence DGISSLCYSSLSKSLLSQPLRETS-SAINDISLLQALMPLLGWTSHWTCITVGLY (SEQ ID NO:424) in Z25377_PEA_1_P15 (SEQ ID NO:320).

Comparison report between Z25377_PEA_1_P15 (SEQ ID NO:320) and BAC85244 (SEQ ID NO:341):

1. An isolated chimeric polypeptide encoding for Z25377_PEA_1_P15 (SEQ ID NO:320), comprising a first amino acid sequence being at least 90% homologous to MRGEHNSTSYDSAVIYRGFWAVLMLLGV-VAVVIASFLIICAAPFASHFLYKAGGGSYIA A corresponding to amino acids 97-156 of BAC85244 (SEQ ID NO:341), which also corresponds to amino acids 1-60 of Z25377_PEA_1_P15 (SEQ ID NO:320), and a second amino acid sequence being at least 70%, optionally at least 80%, preferably at least 85%, more preferably at least 90% and most preferably at least 95% homologous to a polypeptide having the sequence DGISSLCYSSLSKSLLSQPL-RETSSAINDISLLQALMPLLGWTSHWTCITVGLY (SEQ ID NO:424) corresponding to amino acids 61-114 of Z25377_PEA_1_P15 (SEQ ID NO:320), wherein said first amino acid sequence and second amino acid sequence are contiguous and in a sequential order.

2. An isolated polypeptide encoding for a tail of Z25377_PEA_1_P15 (SEQ ID NO:320), comprising a polypeptide being at least 70%, optionally at least about 80%, preferably at least about 85%, more preferably at least about 90% and most preferably at least about 95% homologous to the sequence DGISSLCYSSLSKSLLSQPLRETS-SAINDISLLQALMPLLGWTSHWTCITVGLY (SEQ ID NO:424) in Z25377_PEA_1_P15 (SEQ ID NO:320).

The location of the variant protein was determined according to results from a number of different software programs and analyses, including analyses from SignalP and other specialized programs. The variant protein is believed to be located as follows with regard to the cell: membrane. The protein localization is believed to be membrane because the Signalp_hmm software predicts that this protein has a signal anchor region.

Variant protein Z25377_PEA_1_P15 (SEQ ID NO:320) is encoded by the following transcript(s): Z25377_PEA_1_T1 (SEQ ID NO:42), for which the sequence(s) is/are given at the end of the application. The coding portion of transcript Z25377_PEA_1_T1 (SEQ ID NO:42) is shown in bold; this coding portion starts at position 261 and ends at position 602. The transcript also has the following SNPs as listed in Table 8 (given according to their position on the nucleotide sequence, with the alternative nucleic acid listed; the last column indicates whether the SNP is known or not; the presence of known SNPs in variant protein Z25377_PEA_1_P15 (SEQ ID NO:320) sequence provides support for the deduced sequence of this variant protein according to the present invention).

TABLE 8

| Nucleic acid SNPs | | |
|---|---|---|
| SNP position on nucleotide sequence | Alternative nucleic acid | Previously known SNP? |
| 608 | T -> | No |
| 610 | T -> A | No |

Variant protein Z25377_PEA_1_P17 (SEQ ID NO:321) according to the present invention has an amino acid sequence as given at the end of the application; it is encoded by transcript(s) Z25377_PEA_1_T5 (SEQ ID NO:43). An alignment is given to the known protein (Hypothetical protein FLJ26352 (SEQ ID NO:390)) at the end of the application. One or more alignments to one or more previously published protein sequences are given at the end of the application. A brief description of the relationship of the variant protein according to the present invention to each such aligned protein is as follows:

Comparison report between Z25377_PEA_1_P17 (SEQ ID NO:321) and Q96NR4 (SEQ ID NO:342):

1. An isolated chimeric polypeptide encoding for Z25377_PEA_1_P17 (SEQ ID NO:321), comprising a first amino acid sequence being at least 90% homologous to MRGEHNSTSYDSAV corresponding to amino acids 1-14 of Q96NR4 (SEQ ID NO:342), which also corresponds to amino acids 1-14 of Z25377_PEA_1_P17 (SEQ ID NO:321), a second amino acid sequence bridging amino acid sequence comprising of S, and a third amino acid sequence being at least 90% homologous to ILFSLVVM-LYVIWVQAVADMESYRNMKMKDCLD-FTPSVLYGWSFFLAPAGIFFSLLAG LLFLVVGRHI-QIHH corresponding to amino acids 62-133 of Q96NR4 (SEQ ID NO:342), which also corresponds to amino acids 16-87 of Z25377_PEA_1_P17 (SEQ ID NO:321), wherein said first amino acid sequence, second amino acid sequence and third amino acid sequence are contiguous and in a sequential order.

2. An isolated polypeptide encoding for an edge portion of Z25377_PEA_1_P17 (SEQ ID NO:321), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise VSI having a structure as follows (numbering according to Z25377_PEA_1_P17 (SEQ ID NO:321)): a sequence starting from any of amino acid numbers 14–x to 14; and ending at any of amino acid numbers 16+((n−2)−x), in which x varies from 0 to n−2.

Comparison report between Z25377_PEA_1_P17 (SEQ ID NO:321) and Q8WW45 (SEQ ID NO:343):

1. An isolated chimeric polypeptide encoding for Z25377_PEA_1_P17 (SEQ ID NO:321), comprising a first amino acid sequence being at least 70%, optionally at least 80%, preferably at least 85%, more preferably at least 90% and most preferably at least 95% homologous to a polypeptide having the sequence MRGEHNSTSYDSAVS (SEQ ID NO:426) corresponding to amino acids 1-15 of Z25377_PEA_1_P17 (SEQ ID NO:321), and a second amino acid sequence being at least 90% homologous to ILFSLVVMLYVIWVQAVADMESYRNMK-MKDCLDFTPSVLYGWSFFLAPAGIFFSLLAG LLFLV-VGRHIQIHH corresponding to amino acids 39-110 of Q8WW45 (SEQ ID NO:343), which also corresponds to amino acids 16-87 of Z25377_PEA_1_P17 (SEQ ID NO:321), wherein said first amino acid sequence and second amino acid sequence are contiguous and in a sequential order.

2. An isolated polypeptide encoding for a head of Z25377_PEA_1_P17 (SEQ ID NO:321), comprising a polypeptide being at least 70%, optionally at least about 80%, preferably at least about 85%, more preferably at least about 90% and most preferably at least about 95% homologous to the sequence MRGEHNSTSYDSAVS (SEQ ID NO:426) of Z25377_PEA_1_P17 (SEQ ID NO:321).

Comparison report between Z25377_PEA_1_P17 (SEQ ID NO:321) and BAC85244 (SEQ ID NO:341):

1. An isolated chimeric polypeptide encoding for Z25377_PEA_1_P17 (SEQ ID NO:321), comprising a first amino acid sequence being at least 90% homologous to MRGEHNSTSYDSAV corresponding to amino acids 97-110 of BAC85244 (SEQ ID NO:341), which also corresponds to amino acids 1-14 of Z25377_PEA_1_P17 (SEQ ID NO:321), a second amino acid sequence bridging amino acid sequence comprising of S, and a third amino acid sequence being at least 90% homologous to ILFSLVVM-LYVIWVQAVADMESYRNMKMKDCLD-FTPSVLYGWSFFLAPAGIFFSLLAG LLFLVVGRHI-QIHH corresponding to amino acids 158-229 of BAC85244 (SEQ ID NO:341), which also corresponds to amino acids 16-87 of Z25377_PEA_1_P17 (SEQ ID NO:321), wherein said first amino acid sequence, second amino acid sequence and third amino acid sequence are contiguous and in a sequential order.

2. An isolated polypeptide encoding for an edge portion of Z25377_PEA_1_P17 (SEQ ID NO:321), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise VSI having a structure as follows (numbering according to Z25377_PEA_1_P17 (SEQ ID NO:321)): a sequence starting from any of amino acid numbers 14−x to 14; and ending at any of amino acid numbers 16+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein Z25377_PEA_1_P17 (SEQ ID NO:321) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein Z25377_PEA_1_P17 (SEQ ID NO:321) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 81 | R -> W | Yes |

Variant protein Z25377_PEA_1_P17 (SEQ ID NO:321) is encoded by the following transcript(s): Z25377_PEA_1_T5 (SEQ ID NO:43), for which the sequence(s) is/are given at the end of the application. The coding portion of transcript Z25377_PEA_1_T5 (SEQ ID NO:43) is shown in bold; this coding portion starts at position 261 and ends at position 521. The transcript also has the following SNPs as listed in Table 10 (given according to their position on the nucleotide sequence, with the alternative nucleic acid listed; the last column indicates whether the SNP is known or not; the presence of known SNPs in variant protein Z25377_PEA_1_P17 (SEQ ID NO:321) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 501 | C -> T | Yes |
| 1415 | T -> C | Yes |
| 1434 | A -> G | Yes |
| 1822 | C -> T | Yes |
| 1884 | G -> A | Yes |
| 2392 | C -> G | Yes |
| 2454 | T -> C | No |
| 2618 | C -> T | Yes |
| 2724 | T -> A | Yes |

Variant protein Z25377_PEA_1_P18 (SEQ ID NO:322) according to the present invention has an amino acid sequence as given at the end of the application; it is encoded by transcript(s) Z25377_PEA_1_T7 (SEQ ID NO:44). An alignment is given to the known protein (Hypothetical protein FLJ26352 (SEQ ID NO:390)) at the end of the application. One or more alignments to one or more previously published protein sequences are given at the end of the application. A brief description of the relationship of the variant protein according to the present invention to each such aligned protein is as follows:

Comparison report between Z25377_PEA_1_P18 (SEQ ID NO:322) and Q96NR4 (SEQ ID NO:342):

1. An isolated chimeric polypeptide encoding for Z25377_PEA_1_P18 (SEQ ID NO:322), comprising a first amino acid sequence being at least 90% homologous to MRGEHNSTSYDSAVIYRGFWAVLMLLGV-VAVVIASFLIICAAPFASHFLYKAGGGSYIA AGI corresponding to amino acids 1-62 of Q96NR4 (SEQ ID NO:342), which also corresponds to amino acids 1-62 of Z25377_PEA_1_P18 (SEQ ID NO:322).

Comparison report between Z25377_PEA_1_P18 (SEQ ID NO:322) and Q8WW45 (SEQ ID NO:343):

1. An isolated chimeric polypeptide encoding for Z25377_PEA_1_P18 (SEQ ID NO:322), comprising a first amino acid sequence being at least 70%, optionally at least 80%, preferably at least 85%, more preferably at least 90% and most preferably at least 95% homologous to a polypeptide having the sequence MRGEHNSTSYDSAVIYRGF-WAVL (SEQ ID NO:427) corresponding to amino acids 1-23 of Z25377_PEA_1_P18 (SEQ ID NO:322), and a second amino acid sequence being at least 90% homologous to MLLGVVAVVIASFLIICAAPFASHFLYK-AGGGSYIAAGI corresponding to amino acids 1-39 of Q8WW45 (SEQ ID NO:343), which also corresponds to amino acids 24-62 of Z25377_PEA_1_P18 (SEQ ID NO:322), wherein said first amino acid sequence and second amino acid sequence are contiguous and in a sequential order.

2. An isolated polypeptide encoding for a head of Z25377_PEA_1_P18 (SEQ ID NO:322), comprising a polypeptide being at least 70%, optionally at least about 80%, preferably at least about 85%, more preferably at least about 90% and most preferably at least about 95% homologous to the sequence MRGEHNSTSYDSAVIYRGFWAVL (SEQ ID NO:427) of Z25377_PEA_1_P 18 (SEQ ID NO:322).

Comparison report between Z25377_PEA_1_P18 (SEQ ID NO:322) and BAC85244 (SEQ ID NO:341):

1. An isolated chimeric polypeptide encoding for Z25377_PEA_1_P18 (SEQ ID NO:322), comprising a first amino acid sequence being at least 90% homologous to MRGEHNSTSYDSAVIYRGFWAVLMLLGV-VAVVIASFLIICAAPFASHFLYKAGGGSYIA AGI corresponding to amino acids 97-158 of BAC85244 (SEQ ID NO:341), which also corresponds to amino acids 1-62 of Z25377_PEA_1_P18 (SEQ ID NO:322).

The location of the variant protein was determined according to results from a number of different software programs and analyses, including analyses from SignalP and other specialized programs. The variant protein is believed to be located as follows with regard to the cell: membrane. The protein localization is believed to be membrane because the Signalp_hmm software predicts that this protein has a signal anchor region.

Variant protein Z25377_PEA_1_P18 (SEQ ID NO:322) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein Z25377_PEA_1_P18 (SEQ ID NO:322) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 61 | G -> E | No |

Variant protein Z25377_PEA_1_P18 (SEQ ID NO:322) is encoded by the following transcript(s): Z25377_PEA_1_T7 (SEQ ID NO:44), for which the sequence(s) is/are given at the end of the application. The coding portion of transcript Z25377_PEA_1_T7 (SEQ ID NO:44) is shown in bold; this coding portion starts at position 261 and ends at position 446. The transcript also has the following SNPs as listed in Table 12 (given according to their position on the nucleotide sequence, with the alternative nucleic acid listed; the last column indicates whether the SNP is known or not; the presence of known SNPs in variant protein Z25377_PEA_1_P18 (SEQ ID NO:322) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 442 | G -> A | No |
| 718 | T -> | No |
| 720 | T -> A | No |

Variant protein Z25377_PEA_1_P19 (SEQ ID NO:323) according to the present invention has an amino acid sequence as given at the end of the application; it is encoded by transcript(s) Z25377_PEA_1_T8 (SEQ ID NO:45). The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein Z25377_PEA_1_P19 (SEQ ID NO:323) is encoded by the following transcript(s): Z25377_PEA_1_T8 (SEQ ID NO:45), for which the sequence(s) is/are given at the end of the application. The coding portion of transcript Z25377_PEA_1_T8 (SEQ ID NO:45) is shown in bold; this coding portion starts at position 127 and ends at position 261. The transcript also has the following SNPs as listed in Table 13 (given according to their position on the nucleotide sequence, with the alternative nucleic acid listed; the last column indicates whether the SNP is known or not; the presence of known SNPs in variant protein Z25377_PEA_1_P19 (SEQ ID NO:323) sequence provides support for the deduced sequence of this variant protein according to the present invention).

TABLE 13

Nucleic acid SNPs

| SNP position on nucleotide sequence | Alternative nucleic acid | Previously known SNP? |
|---|---|---|
| 354 | C -> T | Yes |
| 508 | A -> G | Yes |

Variant protein Z25377_PEA_1_P20 (SEQ ID NO:324) according to the present invention has an amino acid sequence as given at the end of the application; it is encoded by transcript(s) Z25377_PEA_1_T9 (SEQ ID NO:46). An alignment is given to the known protein (Hypothetical protein FLJ26352 (SEQ ID NO:390)) at the end of the application. One or more alignments to one or more previously published protein sequences are given at the end of the application. A brief description of the relationship of the variant protein according to the present invention to each such aligned protein is as follows:

Comparison report between Z25377_PEA_1_P20 (SEQ ID NO:324) and Q96NR4 (SEQ ID NO:342):

1. An isolated chimeric polypeptide encoding for Z25377_PEA_1_P20 (SEQ ID NO:324), comprising a first amino acid sequence being at least 90% homologous to MRGEHNSTSYDSAVIYRGFWAVLMLLGV-VAVVIASFLIICAAPFASHFLYKAGGGSYIA A corresponding to amino acids 1-60 of Q96NR4 (SEQ ID NO:342), which also corresponds to amino acids 1-60 of Z25377_PEA_1_P20 (SEQ ID NO:324), and a second amino acid sequence being at least 70%, optionally at least 80%, preferably at least 85%, more preferably at least 90% and most preferably at least 95% homologous to a polypeptide having the sequence VSVGQECGSG (SEQ ID NO:423) corresponding to amino acids 61-70 of Z25377_PEA_1_P20 (SEQ ID NO:324), wherein said first amino acid sequence and second amino acid sequence are contiguous and in a sequential order.

2. An isolated polypeptide encoding for a tail of Z25377_PEA_1_P20 (SEQ ID NO:324), comprising a polypeptide being at least 70%, optionally at least about 80%, preferably at least about 85%, more preferably at least about 90% and most preferably at least about 95% homologous to the sequence VSVGQECGSG (SEQ ID NO:423) in Z25377_PEA_1_P20 (SEQ ID NO:324).

Comparison report between Z25377_PEA_1_P20 (SEQ ID NO:324) and Q8WW45 (SEQ ID NO:343):

1. An isolated chimeric polypeptide encoding for Z25377_PEA_1_P20 (SEQ ID NO:324), comprising a first amino acid sequence being at least 70%, optionally at least 80%, preferably at least 85%, more preferably at least 90% and most preferably at least 95% homologous to a polypeptide having the sequence MRGEHNSTSYDSAVIYRGF-WAVL (SEQ ID NO:427) corresponding to amino acids 1-23 of Z25377_PEA_1_P20 (SEQ ID NO:324), a second amino acid sequence being at least 90% homologous to MLLGVVAVVIASFLIICAAPFASHFLYKAGGGSYIAA corresponding to amino acids 1-37 of Q8WW45 (SEQ ID NO:343), which also corresponds to amino acids 24-60 of Z25377_PEA_1_P20 (SEQ ID NO:324), and a third amino acid sequence being at least 70%, optionally at least 80%, preferably at least 85%, more preferably at least 90% and most preferably at least 95% homologous to a polypeptide having the sequence VSVGQECGSG (SEQ ID NO:423) corresponding to amino acids 61-70 of Z25377_PEA_1_P20 (SEQ ID NO:324), wherein said first amino acid sequence, second amino acid sequence and third amino acid sequence are contiguous and in a sequential order.

2. An isolated polypeptide encoding for a head of Z25377_PEA_1_P20 (SEQ ID NO:324), comprising a polypeptide being at least 70%, optionally at least about 80%, preferably at least about 85%, more preferably at least about 90% and most preferably at least about 95% homologous to the sequence MRGEHNSTSYDSAVIYRGFWAVL (SEQ ID NO:427) of Z25377_PEA_1_P20 (SEQ ID NO:324).

3. An isolated polypeptide encoding for a tail of Z25377_PEA_1_P20 (SEQ ID NO:324), comprising a polypeptide being at least 70%, optionally at least about 80%, preferably at least about 85%, more preferably at least about 90% and most preferably at least about 95% homologous to the sequence VSVGQECGSG (SEQ ID NO:423) in Z25377_PEA_1_P20 (SEQ ID NO:324).

Comparison report between Z25377_PEA_1_P20 (SEQ ID NO:324) and BAC85244 (SEQ ID NO:341):

1. An isolated chimeric polypeptide encoding for Z25377_PEA_1_P20 (SEQ ID NO:324), comprising a first amino acid sequence being at least 90% homologous to MRGEHNSTSYDSAVIYRGFWAVLMLLGV-VAVVIASFLIICAAPFASHFLYKAGGGSYIA A corresponding to amino acids 97-156 of BAC85244 (SEQ ID NO:341), which also corresponds to amino acids 1-60 of Z25377_PEA_1_P20 (SEQ ID NO:324), and a second amino acid sequence being at least 70%, optionally at least 80%, preferably at least 85%, more preferably at least 90% and most preferably at least 95% homologous to a polypeptide having the sequence VSVGQECGSG (SEQ ID NO:423) corresponding to amino acids 61-70 of Z25377_PEA_1_P20 (SEQ ID NO:324), wherein said first amino acid sequence and second amino acid sequence are contiguous and in a sequential order.

2. An isolated polypeptide encoding for a tail of Z25377_PEA_1_P20 (SEQ ID NO:324), comprising a polypeptide being at least 70%, optionally at least about 80%, preferably at least about 85%, more preferably at least about 90% and most preferably at least about 95% homologous to the sequence VSVGQECGSG (SEQ ID NO:423) in Z25377_PEA_1_P20 (SEQ ID NO:324).

The location of the variant protein was determined according to results from a number of different software programs and analyses, including analyses from SignalP and other specialized programs. The variant protein is believed to be located as follows with regard to the cell: membrane. The protein localization is believed to be membrane because the Signalp_hmm software predicts that this protein has a signal anchor region.

Variant protein Z25377_PEA_1_P20 (SEQ ID NO:324) is encoded by the following transcript(s): Z25377_PEA_1_T9 (SEQ ID NO:46), for which the sequence(s) is/are given at the end of the application. The coding portion of transcript Z25377_PEA_1_T9 (SEQ ID NO:46) is shown in bold; this coding portion starts at position 261 and ends at position 470.

Variant protein Z25377_PEA_1_P21 (SEQ ID NO:325) according to the present invention has an amino acid sequence as given at the end of the application; it is encoded by transcript(s) Z25377_PEA_1_T10 (SEQ ID NO:47). The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein Z25377_PEA_1_P21 (SEQ ID NO:325) is encoded by the following transcript(s): Z25377_PEA_1_T10 (SEQ ID NO:47), for which the sequence(s) is/are given at the end of the application. The coding portion of transcript Z25377_PEA_1_T10 (SEQ ID NO:47) is shown in bold; this coding portion starts at position 261 and ends at position 464. The transcript also has the following SNPs as listed in Table 14 (given according to their position on the nucleotide sequence, with the alternative nucleic acid listed; the last column indicates whether the SNP is known or not; the presence of known SNPs in variant protein Z25377_PEA_1_P21 (SEQ ID NO:325) sequence provides support for the deduced sequence of this variant protein according to the present invention).

TABLE 14

| SNP position on nucleotide sequence | Nucleic acid SNPs Alternative nucleic acid | Previously known SNP? |
|---|---|---|
| 470 | T -> | No |
| 472 | T -> A | No |

As noted above, cluster Z25377 features 12 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z25377_PEA_1_node_5 (SEQ ID NO:197) according to the present invention is supported by 1 libraries. The number of libraries was determined as previously described. This segment can be found in the following transcript(s): Z25377_PEA_1_T11(SEQ ID NO:48), Z25377_PEA_1_T12 (SEQ ID NO:49) and Z25377_PEA_1_T13 (SEQ ID NO:50). Table 15 below describes the starting and ending position of this segment on each transcript.

TABLE 15

| Segment location on transcripts | | |
|---|---|---|
| Transcript name | Segment starting position | Segment ending position |
| Z25377_PEA_1_T11 (SEQ ID NO: 48) | 1 | 319 |
| Z25377_PEA_1_T12 (SEQ ID NO: 49) | 1 | 319 |
| Z25377_PEA_1_T13 (SEQ ID NO: 50) | 1 | 319 |

Segment cluster Z25377_PEA_1_node_12 (SEQ ID NO:198) according to the present invention is supported by 2 libraries. The number of libraries was determined as previously described. This segment can be found in the following transcript(s): Z25377_PEA_1_T8 (SEQ ID NO:45). Table 16 below describes the starting and ending position of this segment on each transcript.

TABLE 16

Segment location on transcripts

| Transcript name | Segment starting position | Segment ending position |
|---|---|---|
| Z25377_PEA_1_T8 (SEQ ID NO: 45) | 304 | 708 |

Segment cluster Z25377_PEA_1_node_15 (SEQ ID NO:199) according to the present invention is supported by 19 libraries. The number of libraries was determined as previously described. This segment can be found in the following transcript(s): Z25377_PEA_1_T1 (SEQ ID NO:42), Z25377_PEA_1_T7 (SEQ ID NO:44), Z25377_PEA_1_T9 (SEQ ID NO:46), Z25377_PEA_1_T11 (SEQ ID NO:48), Z25377_PEA_1_T12 (SEQ ID NO:49) and Z25377_PEA_1_T13 (SEQ ID NO:50). Table 17 below describes the starting and ending position of this segment on each transcript.

TABLE 17

Segment location on transcripts

| Transcript name | Segment starting position | Segment ending position |
|---|---|---|
| Z25377_PEA_1_T1 (SEQ ID NO: 42) | 304 | 441 |
| Z25377_PEA_1_T7 (SEQ ID NO: 44) | 304 | 441 |
| Z25377_PEA_1_T9 (SEQ ID NO: 46) | 304 | 441 |
| Z25377_PEA_1_T11 (SEQ ID NO: 48) | 519 | 656 |
| Z25377_PEA_1_T12 (SEQ ID NO: 49) | 519 | 656 |
| Z25377_PEA_1_T13 (SEQ ID NO: 50) | 519 | 656 |

Segment cluster Z25377_PEA_1_node_17 (SEQ ID NO:200) according to the present invention is supported by 16 libraries. The number of libraries was determined as previously described. This segment can be found in the following transcript(s): Z25377_PEA_1_T5 (SEQ ID NO:43). Table 18 below describes the starting and ending position of this segment on each transcript.

TABLE 18

Segment location on transcripts

| Transcript name | Segment starting position | Segment ending position |
|---|---|---|
| Z25377_PEA_1_T5 (SEQ ID NO: 43) | 304 | 491 |

Segment cluster Z25377_PEA_1_node_18 (SEQ ID NO:201) according to the present invention is supported by 55 libraries. The number of libraries was determined as previously described. This segment can be found in the following transcript(s): Z25377_PEA_1_T5 (SEQ ID NO:43). Table 19 below describes the starting and ending position of this segment on each transcript.

TABLE 19

Segment location on transcripts

| Transcript name | Segment starting position | Segment ending position |
|---|---|---|
| Z25377_PEA_1_T5 (SEQ ID NO: 43) | 492 | 3969 |

Segment cluster Z25377_PEA_1_node_22 (SEQ ID NO:202) according to the present invention is supported by 6 libraries. The number of libraries was determined as previously described. This segment can be found in the following transcript(s): Z25377_PEA_1_T1 (SEQ ID NO:42), Z25377_PEA_1_T7 (SEQ ID NO:44), Z25377_PEA_1_T10 (SEQ ID NO:47), Z25377_PEA_1_T11 (SEQ ID NO:48) and Z25377_PEA_1_T13 (SEQ ID NO:50). Table 20 below describes the starting and ending position of this segment on each transcript.

TABLE 20

Segment location on transcripts

| Transcript name | Segment starting position | Segment ending position |
|---|---|---|
| Z25377_PEA_1_T1 (SEQ ID NO: 42) | 442 | 868 |
| Z25377_PEA_1_T7 (SEQ ID NO: 44) | 552 | 978 |
| Z25377_PEA_1_T10 (SEQ ID NO: 47) | 304 | 730 |
| Z25377_PEA_1_T11 (SEQ ID NO: 48) | 767 | 1193 |
| Z25377_PEA_1_T13 (SEQ ID NO: 50) | 657 | 1083 |

Segment cluster Z25377_PEA_1_node_24 (SEQ ID NO:203) according to the present invention is supported by 1 libraries. The number of libraries was determined as previously described. This segment can be found in the following transcript(s): Z25377_PEA_1_T9 (SEQ ID NO:46) and Z25377_PEA_1_T12 (SEQ ID NO:49). Table 21 below describes the starting and ending position of this segment on each transcript.

TABLE 21

Segment location on transcripts

| Transcript name | Segment starting position | Segment ending position |
|---|---|---|
| Z25377_PEA_1_T9 (SEQ ID NO: 46) | 442 | 783 |
| Z25377_PEA_1_T12 (SEQ ID NO: 49) | 657 | 998 |

According to an optional embodiment of the present invention, short segments related to the above cluster are also provided. These segments are up to about 120 bp in length, and so are included in a separate description.

Segment cluster Z25377_PEA_1_node_0 (SEQ ID NO:204) according to the present invention is supported by 14 libraries. The number of libraries was determined as previously described. This segment can be found in the following transcript(s): Z25377_PEA_1_T1 (SEQ ID NO:42), Z25377_PEA_1_T5 (SEQ ID NO:43), Z25377_PEA_1_T7 (SEQ ID NO:44), Z25377_PEA_1_T8 (SEQ ID NO:45), Z25377_PEA_1_T9 (SEQ ID NO:46) and Z25377_PEA_1_T10 (SEQ ID NO:47). Table 22 below describes the starting and ending position of this segment on each transcript.

TABLE 22

Segment location on transcripts

| Transcript name | Segment starting position | Segment ending position |
|---|---|---|
| Z25377_PEA_1_T1 (SEQ ID NO: 42) | 1 | 104 |
| Z25377_PEA_1_T5 (SEQ ID NO: 43) | 1 | 104 |
| Z25377_PEA_1_T7 (SEQ ID NO: 44) | 1 | 104 |
| Z25377_PEA_1_T8 (SEQ ID NO: 45) | 1 | 104 |
| Z25377_PEA_1_T9 (SEQ ID NO: 46) | 1 | 104 |
| Z25377_PEA_1_T10 (SEQ ID NO: 47) | 1 | 104 |

Segment cluster Z25377_PEA_1_node_7 (SEQ ID NO:205) according to the present invention is supported by 19 libraries. The number of libraries was determined as previously described. This segment can be found in the following transcript(s): Z25377_PEA_1_T1 (SEQ ID NO:42), Z25377_PEA_1_T5 (SEQ ID NO:43), Z25377_PEA_1_T7 (SEQ ID NO:44), Z25377_PEA_1_T8 (SEQ ID NO:45), Z25377_PEA_1_T9 (SEQ ID NO:46), Z25377_PEA_1_T10 (SEQ ID NO:47), Z25377_PEA_1_T11 (SEQ ID NO:48), Z25377_PEA_1_T12 (SEQ ID NO:49) and Z25377_PEA_1_T13 (SEQ ID NO:50). Table 23 below describes the starting and ending position of this segment on each transcript.

TABLE 23

Segment location on transcripts

| Transcript name | Segment starting position | Segment ending position |
|---|---|---|
| Z25377_PEA_1_T1 (SEQ ID NO: 42) | 105 | 199 |
| Z25377_PEA_1_T5 (SEQ ID NO: 43) | 105 | 199 |
| Z25377_PEA_1_T7 (SEQ ID NO: 44) | 105 | 199 |
| Z25377_PEA_1_T8 (SEQ ID NO: 45) | 105 | 199 |
| Z25377_PEA_1_T9 (SEQ ID NO: 46) | 105 | 199 |
| Z25377_PEA_1_T10 (SEQ ID NO: 47) | 105 | 199 |
| Z25377_PEA_1_T11 (SEQ ID NO: 48) | 320 | 414 |
| Z25377_PEA_1_T12 (SEQ ID NO: 49) | 320 | 414 |
| Z25377_PEA_1_T13 (SEQ ID NO: 50) | 320 | 414 |

Segment cluster Z25377_PEA_1_node_8 (SEQ ID NO:206) according to the present invention can be found in the following transcript(s): Z25377_PEA_1_T1 (SEQ ID NO:42), Z25377_PEA_1_T5 (SEQ ID NO:43), Z25377_PEA_1_T7 (SEQ ID NO:44), Z25377_PEA_1_T8 (SEQ ID NO:45), Z25377_PEA_1_T9 (SEQ ID NO:46), Z25377_PEA_1_T10 (SEQ ID NO:47), Z25377_PEA_1_T11 (SEQ ID NO:48), Z25377_PEA_1_T12 (SEQ ID NO:49) and Z25377_PEA_1_T13 (SEQ ID NO:50). Table 24 below describes the starting and ending position of this segment on each transcript.

TABLE 24

Segment location on transcripts

| Transcript name | Segment starting position | Segment ending position |
|---|---|---|
| Z25377_PEA_1_T1 (SEQ ID NO: 42) | 200 | 204 |
| Z25377_PEA_1_T5 (SEQ ID NO: 43) | 200 | 204 |
| Z25377_PEA_1_T7 (SEQ ID NO: 44) | 200 | 204 |
| Z25377_PEA_1_T8 (SEQ ID NO: 45) | 200 | 204 |
| Z25377_PEA_1_T9 (SEQ ID NO: 46) | 200 | 204 |
| Z25377_PEA_1_T10 (SEQ ID NO: 47) | 200 | 204 |
| Z25377_PEA_1_T11 (SEQ ID NO: 48) | 415 | 419 |
| Z25377_PEA_1_T12 (SEQ ID NO: 49) | 415 | 419 |
| Z25377_PEA_1_T13 (SEQ ID NO: 50) | 415 | 419 |

Segment cluster Z25377_PEA_1_node_10 (SEQ ID NO:207) according to the present invention is supported by 20 libraries. The number of libraries was determined as previously described. This segment can be found in the following transcript(s): Z25377_PEA_1_T1 (SEQ ID NO:42), Z25377_PEA_1_T5 (SEQ ID NO:43), Z25377_PEA_1_T7 (SEQ ID NO:44), Z25377_PEA_1_T8 (SEQ ID NO:45), Z25377_PEA_1_T9 (SEQ ID NO:46), Z25377_PEA_1_T10 (SEQ ID NO:47), Z25377_PEA_1_T11 (SEQ ID NO:48), Z25377_PEA_1_T12 (SEQ ID NO:49) and Z25377_PEA_1_T13 (SEQ ID NO:50). Table 25 below describes the starting and ending position of this segment on each transcript.

TABLE 25

Segment location on transcripts

| Transcript name | Segment starting position | Segment ending position |
|---|---|---|
| Z25377_PEA_1_T1 (SEQ ID NO: 42) | 205 | 303 |
| Z25377_PEA_1_T5 (SEQ ID NO: 43) | 205 | 303 |
| Z25377_PEA_1_T7 (SEQ ID NO: 44) | 205 | 303 |
| Z25377_PEA_1_T8 (SEQ ID NO: 45) | 205 | 303 |
| Z25377_PEA_1_T9 (SEQ ID NO: 46) | 205 | 303 |
| Z25377_PEA_1_T10 (SEQ ID NO: 47) | 205 | 303 |
| Z25377_PEA_1_T11 (SEQ ID NO: 48) | 420 | 518 |
| Z25377_PEA_1_T12 (SEQ ID NO: 49) | 420 | 518 |
| Z25377_PEA_1_T13 (SEQ ID NO: 50) | 420 | 518 |

Segment cluster Z25377_PEA_1_node_20 (SEQ ID NO:208) according to the present invention is supported by 1 libraries. The number of libraries was determined as previously described. This segment can be found in the following transcript(s): Z25377_PEA_1_T7 (SEQ ID NO:44) and Z25377_PEA_1_T111 (SEQ ID NO:48). Table 26 below describes the starting and ending position of this segment on each transcript.

TABLE 26

Segment location on transcripts

| Transcript name | Segment starting position | Segment ending position |
|---|---|---|
| Z25377_PEA_1_T7 (SEQ ID NO: 44) | 442 | 551 |
| Z25377_PEA_1_T11 (SEQ ID NO: 48) | 657 | 766 |

Variant Protein Alignment to the Previously Known Protein:
Sequence name: BAC85244 (SEQ ID NO:341)
Alignment of: Z25377_PEA_1_P12 (SEQ ID NO:317)+ BAC85244 (SEQ ID NO:341)

Alignment segment 1/1:

| | | | |
|---|---|---|---|
| Quality: | 1575.00 | Escore: | 0 |
| Matching length: | 158 | Total length: | 158 |

-continued

Alignment segment 1/1:

| | | | |
|---|---|---|---|
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MRLNIAIFFGALFGALGVLLFLVAFGSDYWLLATEVGRCSGEKNIENVTF  50
    ||||||||||||||||||||||||||||||||||||||||||||||||||
  1 MRLNIAIFFGALFGALGVLLFLVAFGSDYWLLATEVGRCSGEKNIENVTF  50

51 HHEGFFWRCWFNGIVEENDSNIWKFWYTNQPPSKNCTHAYLSPYPFMRGE 100
    ||||||||||||||||||||||||||||||||||||||||||||||||||
 51 HHEGFFWRCWFNGIVEENDSNIWKFWYTNQPPSKNCTHAYLSPYPFMRGE 100

101 HNSTSYDSAVIYRGFWAVLMLLGVVAVVIASFLIICAAPFASHFLYKAGG 150
    ||||||||||||||||||||||||||||||||||||||||||||||||||
101 HNSTSYDSAVIYRGFWAVLMLLGVVAVVIASFLIICAAPFASHFLYKAGG 150
151 GSYIAAGI                                           158
    ||||||||
151 GSYIAAGI                                           158
```

Sequence name: BAC85244 (SEQ ID NO:341)

Sequence documentation:

Alignment of: Z25377_PEA_1_P13 (SEQ ID NO:318)+ BAC85244 (SEQ ID NO:341)

Alignment segment 1/1:

| | | | |
|---|---|---|---|
| Quality: | 1558.00 | Escore: | 0 |
| Matching length: | 156 | Total length: | 156 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MRLNIAIFFGALFGALGVLLFLVAFGSDYWLLATEVGRCSGEKNIENVTF  50
    ||||||||||||||||||||||||||||||||||||||||||||||||||
  1 MRLNIAIFFGALFGALGVLLFLVAFGSDYWLLATEVGRCSGEKNIENVTF  50

51 HHEGFFWRCWFNGIVEENDSNIWKFWYTNQPPSKNCTHAYLSPYPFMRGE 100
    ||||||||||||||||||||||||||||||||||||||||||||||||||
 51 HHEGFFWRCWFNGIVEENDSNIWKFWYTNQPPSKNCTHAYLSPYPFMRGE 100

101 HNSTSYDSAVIYRGFWAVLMLLGVVAVVIASFLIICAAPFASHFLYKAGG 150
    ||||||||||||||||||||||||||||||||||||||||||||||||||
101 HNSTSYDSAVIYRGFWAVLMLLGVVAVVIASFLIICAAPFASHFLYKAGG 150

151 GSYIAA                                             156
    ||||||
151 GSYIAA                                             156
```

Sequence name: BAC85244 (SEQ ID NO:341)

Sequence documentation:

Alignment of: Z25377_PEA_1_P14 (SEQ ID NO:319)+ BAC85244 (SEQ ID NO:341)

Alignment segment 1/1:

| | | | |
|---|---|---|---|
| Quality: | 1559.00 | Escore: | 0 |
| Matching length: | 162 | Total length: | 162 |
| Matching Percent Similarity: | 98.15 | Matching Percent Identity: | 97.53 |
| Total Percent Similarity: | 98.15 | Total Percent Identity: | 97.53 |
| Gaps: | 0 | | |

Alignment:

```
  1  MRLNIAIFFGALFGALGVLLFLVAFGSDYWLLATEVGRCSGEKNIENVTF   50
     ||||||||||||||||||||||||||||||||||||||||||||||||||
  1  MRLNIAIFFGALFGALGVLLFLVAFGSDYWLLATEVGRCSGEKNIENVTF   50

51  HHEGFFWRCWFNGIVEENDSNIWKFWYTNQPPSKNCTHAYLSPYPFMRGE  100
     ||||||||||||||||||||||||||||||||||||||||||||||||||
 51  HHEGFFWRCWFNGIVEENDSNIWKFWYTNQPPSKNCTHAYLSPYPFMRGE  100

101  HNSTSYDSAVIYRGFWAVLMLLGVVAVVIASFLIICAAPFASHFLYKAGG  150
     ||||||||||||||||||||||||||||||||||||||||||||||||||
101  HNSTSYDSAVIYRGFWAVLMLLGVVAVVIASFLIICAAPFASHFLYKAGG  150

151  GSYIAADGISSL                                         162
     ||||||  : ||
151  GSYIAAGILFSL                                         162
```

Sequence name: Q96NR4 (SEQ ID NO:342)

Sequence documentation:

Alignment of: Z25377_PEA_1_P15 (SEQ ID NO:320)+ Q96NR4 (SEQ ID NO:342).

Alignment segment 1/1:

| | | | |
|---|---|---|---|
| Quality: | 572.00 | Escore: | 0 |
| Matching length: | 66 | Total length: | 66 |
| Matching Percent Similarity: | 95.45 | Matching Percent Identity: | 93.94 |
| Total Percent Similarity: | 95.45 | Total Percent Identity: | 93.94 |
| Gaps: | 0 | | |

Alignment:

```
  1  MRGEHNSTSYDSAVIYRGFWAVLMLLGVVAVVIASFLIICAAPFASHFLY   50
     ||||||||||||||||||||||||||||||||||||||||||||||||||
  1  MRGEHNSTSYDSAVIYRGFWAVLMLLGVVAVVIASFLIICAAPFASHFLY   50

51  KAGGGSYIAADGISSL                                      66
     |||||||||||  : ||
 51  KAGGGSYIAAGILFSL                                      66
```

Sequence name: BAC85244 (SEQ ID NO:341)

Sequence documentation:

Alignment of: Z25377_PEA_1_P15 (SEQ ID NO:320)+ BAC85244 (SEQ ID NO:341)

|  | Alignment segment 1/1: | | |
|---|---|---|---|
| Quality: | 572.00 | Escore: | 0 |
| Matching length: | 66 | Total length: | 66 |
| Matching Percent Similarity: | 95.45 | Matching Percent Identity: | 93.94 |
| Total Percent Similarity: | 95.45 | Total Percent Identity: | 93.94 |
| Gaps: | 0 | | |

Alignment:

```
  1 MRGEHNSTSYDSAVIYRGFWAVLMLLGVVAVVIASFLIICAAPFASHFLY  50
    ||||||||||||||||||||||||||||||||||||||||||||||||||
 97 MRGEHNSTSYDSAVIYRGFWAVLMLLGVVAVVIASFLIICAAPFASHFLY 146

51 KAGGGSYIAADGISSL                                    66
    ||||||||||  : ||
147 KAGGGSYIAAGILFSL                                   162
```

Sequence name: Q96NR4 (SEQ ID NO:342)

Sequence documentation:

Alignment of: Z25377_PEA_1_P17 (SEQ ID NO:321)+ Q96NR4 (SEQ ID NO:342).

|  | Alignment segment 1/1: | | |
|---|---|---|---|
| Quality: | 744.00 | Escore: | 0 |
| Matching length: | 87 | Total length: | 133 |
| Matching Percent Similarity: | 98.85 | Matching Percent Identity: | 98.85 |
| Total Percent Similarity: | 64.66 | Total Percent Identity: | 64.66 |
| Gaps: | 1 | | |

Alignment:

```
  1 MRGEHNSTSYDSAV.................................... 14
    ||||||||||||||
  1 MRGEHNSTSYDSAVIYRGFWAVLMLLGVVAVVIASFLIICAAPFASHFLY 50

15 ..........SILFSLVVMLYVIWVQAVADMESYRNMKMKDCLDFTPSVL 54
              ||||||||||||||||||||||||||||||||||||||||
 51 KAGGGSYIAAGILFSLVVMLYVIWVQAVADMESYRNMKMKDCLDFTPSVL 100

55 YGWSFFLAPAGIFFSLLAGLLFLVVGRHIQIHH                  87
    |||||||||||||||||||||||||||||||||
101 YGWSFFLAPAGIFFSLLAGLLFLVVGRHIQIHH                 133
```

Sequence name: Q8WW45 (SEQ ID NO:343)

Sequence documentation:

Alignment of: Z25377_PEA_1_P17 (SEQ ID NO:321)+ Q8WW45 (SEQ ID NO:343).

|  | Alignment segment 1/1: | | |
|---|---|---|---|
| Quality: | 711.00 | Escore: | 0 |
| Matching length: | 75 | Total length: | 75 |
| Matching Percent Similarity: | 97.33 | Matching Percent Identity: | 97.33 |
| Total Percent Similarity: | 97.33 | Total Percent Identity: | 97.33 |
| Gaps: | 0 | | |

Alignment:

```
 13  AVSILFSLVVMLYVIWVQAVADMESYRNMKMKDCLDFTPSVLYGWSFFLA   62
     | ||||||||||||||||||||||||||||||||||||||||||||||||
 36  AAGILFSLVVMLYVIWVQAVADMESYRNMKMKDCLDFTPSVLYGWSFFLA   85

63  PAGIFFSLLAGLLFLVVGRHIQIHH                            87
     |||||||||||||||||||||||||
 86  PAGIFFSLLAGLLFLVVGRHIQIHH                           110
```

Sequence name: BAC85244 (SEQ ID NO:341)

Sequence documentation:

Alignment of: Z25377_PEA_1_P17 (SEQ ID NO:321)+ BAC85244 (SEQ ID NO:341)

|  | Alignment segment 1/1: | | |
|---|---|---|---|
| Quality: | 744.00 | Escore: | 0 |
| Matching length: | 87 | Total length: | 133 |
| Matching Percent Similarity: | 98.85 | Matching Percent Identity: | 98.85 |
| Total Percent Similarity: | 64.66 | Total Percent Identity: | 64.66 |
| Gaps: | 1 | | |

Alignment:

```
  1  MRGEHNSTSYDSAV.................................    14
     ||||||||||||||
 97  MRGEHNSTSYDSAVIYRGFWAVLMLLGVVAVVIASFLIICAAPFASHFLY  146

15  .........SILFSLVVMLYVIWVQAVADMESYRNMKMKDCLDFTPSVL   54
              |||||||||||||||||||||||||||||||||||||||||
147  KAGGGSYIAAGILFSLVVMLYVIWVQAVADMESYRNMKMKDCLDFTPSVL  196

55  YGWSFFLAPAGIFFSLLAGLLFLVVGRHIQIHH                   87
     ||||||||||||||||||||||||||||||||
197  YGWSFFLAPAGIFFSLLAGLLFLVVGRHIQIHH                  229
```

Sequence name: Q96NR4 (SEQ ID NO:342)

Sequence documentation:

Alignment of: Z25377_PEA_1_P18 (SEQ ID NO:322)+ Q96NR4 (SEQ ID NO:342).

Alignment segment 1/1:

| | | | |
|---|---|---|---|
| Quality: | 588.00 | Escore: | 0 |
| Matching length: | 62 | Total length: | 62 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MRGEHNSTSYDSAVIYRGFWAVLMLLGVVAVVIASFLIICAAPFASHFLY  50
    |||||||||||||||||||||||||||||||||||||||||||||||||
 1  MRGEHNSTSYDSAVIYRGFWAVLMLLGVVAVVIASFLIICAAPFASHFLY  50

51  KAGGGSYIAAGI  62
    ||||||||||||
51  KAGGGSYIAAGI  62
```

Sequence name: Q8WW45 (SEQ ID NO:343)

Sequence documentation:

Alignment of: Z25377_PEA_1_P18 (SEQ ID NO:322)+ Q8WW45 (SEQ ID NO:343).

Alignment segment 1/1:

| | | | |
|---|---|---|---|
| Quality: | 358.00 | Escore: | 0 |
| Matching length: | 39 | Total length: | 39 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
24  MLLGVVAVVIASFLIICAAPFASHFLYKAGGGSYIAAGI  62
    |||||||||||||||||||||||||||||||||||||||
 1  MLLGVVAVVIASFLIICAAPFASHFLYKAGGGSYIAAGI  39
```

Sequence name: BAC85244 (SEQ ID NO:341)

Sequence documentation:

Alignment of: Z25377_PEA_1_P18 (SEQ ID NO:322)+ BAC85244 (SEQ ID NO:341)

Alignment segment 1/1:

| | | | |
|---|---|---|---|
| Quality: | 588.00 | Escore: | 0 |
| Matching length: | 62 | Total length: | 62 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MRGEHNSTSYDSAVIYRGFWAVLMLLGVVAVVIASFLIICAAPFASHFLY   50
     |||||||||||||||||||||||||||||||||||||||||||||||||
 97  MRGEHNSTSYDSAVIYRGFWAVLMLLGVVAVVIASFLIICAAPFASHFLY  146

51  KAGGGSYIAAGI   62
     ||||||||||||
147  KAGGGSYIAAGI  158
```

Sequence name: Q96NR4 (SEQ ID NO:342)

Sequence documentation:

Alignment of: Z25377_PEA_1_P20 (SEQ ID NO:324)+ Q96NR4 (SEQ ID NO:342).

---

Alignment segment 1/1:

---

| | | | |
|---|---|---|---|
| Quality: | 571.00 | Escore: | 0 |
| Matching length: | 60 | Total length: | 60 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MRGEHNSTSYDSAVIYRGFWAVLMLLGVVAVVIASFLIICAAPFASHFLY  50
     ||||||||||||||||||||||||||||||||||||||||||||||||||
  1  MRGEHNSTSYDSAVIYRGFWAVLMLLGVVAVVIASFLIICAAPFASHFLY  50

51  KAGGGSYIAA                                          60
     ||||||||||
 51  KAGGGSYIAA                                          60
```

Sequence name: Q8WW45 (SEQ ID NO:343)

Sequence documentation:

Alignment of: Z25377_PEA_1_P20 (SEQ ID NO:324)+ Q8WW45 (SEQ ID NO:343).

---

Alignment segment 1/1:

---

| | | | |
|---|---|---|---|
| Quality: | 341.00 | Escore: | 0 |
| Matching length: | 37 | Total length: | 37 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 24  MLLGVVAVVIASFLIICAAPFASHFLYKAGGGSYIAA  60
     |||||||||||||||||||||||||||||||||||||
  1  MLLGVVAVVIASFLIICAAPFASHFLYKAGGGSYIAA  37
```

Sequence name: BAC85244 (SEQ ID NO:341)

Sequence documentation:

Alignment of: Z25377_PEA_1_P20 (SEQ ID NO:324)+ BAC85244 (SEQ ID NO:341).

---

Alignment segment 1/1:

---

| | | | |
|---|---|---|---|
| Quality: | 571.00 | Escore: | 0 |
| Matching length: | 60 | Total length: | 60 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MRGEHNSTSYDSAVIYRGFWAVLMLLGVVAVVIASFLIICAAPFASHFLY  50
     ||||||||||||||||||||||||||||||||||||||||||||||||||
 97  MRGEHNSTSYDSAVIYRGFWAVLMLLGVVAVVIASFLIICAAPFASHFLY  146

51  KAGGGSYIAA                                          60
     ||||||||||
147  KAGGGSYIAA                                          156
```

Description for Cluster HSACMHCP

Cluster HSACMHCP features 10 transcript(s) and 65 segment(s) of interest, the names for which are given in Tables 1 and 2, respectively, the sequences themselves are given at the end of the application. The selected protein variants are given in table 3.

TABLE 1

Transcripts of interest

| Transcript Name | SEQ ID NO: |
|---|---|
| HSACMHCP_PEA_1_T2 | 51 |
| HSACMHCP_PEA_1_T3 | 52 |
| HSACMHCP_PEA_1_T4 | 53 |
| HSACMHCP_PEA_1_T6 | 54 |
| HSACMHCP_PEA_1_T7 | 55 |
| HSACMHCP_PEA_1_T8 | 56 |
| HSACMHCP_PEA_1_T13 | 57 |
| HSACMHCP_PEA_1_T14 | 58 |
| HSACMHCP_PEA_1_T17 | 59 |
| HSACMHCP_PEA_1_T26 | 60 |

TABLE 2

Segments of interest

| Segment Name | Seq ID No. |
|---|---|
| HSACMHCP_PEA_1_node_2 | 209 |
| HSACMHCP_PEA_1_node_20 | 210 |
| HSACMHCP_PEA_1_node_22 | 211 |
| HSACMHCP_PEA_1_node_25 | 212 |
| HSACMHCP_PEA_1_node_43 | 213 |
| HSACMHCP_PEA_1_node_45 | 214 |
| HSACMHCP_PEA_1_node_46 | 215 |
| HSACMHCP_PEA_1_node_48 | 216 |
| HSACMHCP_PEA_1_node_49 | 217 |
| HSACMHCP_PEA_1_node_57 | 218 |
| HSACMHCP_PEA_1_node_59 | 219 |
| HSACMHCP_PEA_1_node_61 | 220 |
| HSACMHCP_PEA_1_node_63 | 221 |
| HSACMHCP_PEA_1_node_65 | 222 |
| HSACMHCP_PEA_1_node_67 | 223 |
| HSACMHCP_PEA_1_node_71 | 224 |
| HSACMHCP_PEA_1_node_81 | 225 |
| HSACMHCP_PEA_1_node_87 | 226 |
| HSACMHCP_PEA_1_node_89 | 227 |
| HSACMHCP_PEA_1_node_96 | 228 |
| HSACMHCP_PEA_1_node_97 | 229 |
| HSACMHCP_PEA_1_node_100 | 230 |
| HSACMHCP_PEA_1_node_105 | 231 |
| HSACMHCP_PEA_1_node_106 | 232 |
| HSACMHCP_PEA_1_node_107 | 233 |
| HSACMHCP_PEA_1_node_108 | 234 |
| HSACMHCP_PEA_1_node_111 | 235 |
| HSACMHCP_PEA_1_node_113 | 236 |
| HSACMHCP_PEA_1_node_0 | 237 |
| HSACMHCP_PEA_1_node_3 | 238 |
| HSACMHCP_PEA_1_node_4 | 239 |
| HSACMHCP_PEA_1_node_16 | 240 |
| HSACMHCP_PEA_1_node_18 | 241 |
| HSACMHCP_PEA_1_node_23 | 242 |
| HSACMHCP_PEA_1_node_27 | 243 |
| HSACMHCP_PEA_1_node_29 | 244 |
| HSACMHCP_PEA_1_node_31 | 245 |
| HSACMHCP_PEA_1_node_33 | 246 |
| HSACMHCP_PEA_1_node_35 | 247 |
| HSACMHCP_PEA_1_node_37 | 248 |
| HSACMHCP_PEA_1_node_39 | 249 |
| HSACMHCP_PEA_1_node_40 | 250 |
| HSACMHCP_PEA_1_node_51 | 251 |
| HSACMHCP_PEA_1_node_53 | 252 |
| HSACMHCP_PEA_1_node_55 | 253 |
| HSACMHCP_PEA_1_node_69 | 254 |
| HSACMHCP_PEA_1_node_72 | 255 |

TABLE 2-continued

Segments of interest

| Segment Name | Seq ID No. |
|---|---|
| HSACMHCP_PEA_1_node_73 | 256 |
| HSACMHCP_PEA_1_node_74 | 257 |
| HSACMHCP_PEA_1_node_77 | 258 |
| HSACMHCP_PEA_1_node_78 | 259 |
| HSACMHCP_PEA_1_node_80 | 260 |
| HSACMHCP_PEA_1_node_82 | 261 |
| HSACMHCP_PEA_1_node_83 | 262 |
| HSACMHCP_PEA_1_node_84 | 263 |
| HSACMHCP_PEA_1_node_85 | 264 |
| HSACMHCP_PEA_1_node_90 | 265 |
| HSACMHCP_PEA_1_node_91 | 266 |
| HSACMHCP_PEA_1_node_92 | 267 |
| HSACMHCP_PEA_1_node_93 | 268 |
| HSACMHCP_PEA_1_node_95 | 269 |
| HSACMHCP_PEA_1_node_98 | 270 |
| HSACMHCP_PEA_1_node_103 | 271 |
| HSACMHCP_PEA_1_node_104 | 272 |
| HSACMHCP_PEA_1_node_109 | 273 |

TABLE 3

Proteins of interest

| Protein Name | Seq ID No. | Corresponding Transcript(s) |
|---|---|---|
| HSACMHCP_PEA_1_P2 | 326 | HSACMHCP_PEA_1_T2 (SEQ ID NO: 51); HSACMHCP_PEA_1_T6 (SEQ ID NO: 54) |
| HSACMHCP_PEA_1_P3 | 327 | HSACMHCP_PEA_1_T3 (SEQ ID NO: 52) |
| HSACMHCP_PEA_1_P4 | 328 | HSACMHCP_PEA_1_T4 (SEQ ID NO: 53) |
| HSACMHCP_PEA_1_P6 | 329 | HSACMHCP_PEA_1_T7 (SEQ ID NO: 55) |
| HSACMHCP_PEA_1_P12 | 330 | HSACMHCP_PEA_1_T13 (SEQ ID NO: 57) |
| HSACMHCP_PEA_1_P16 | 331 | HSACMHCP_PEA_1_T17 (SEQ ID NO: 59) |
| HSACMHCP_PEA_1_P25 | 332 | HSACMHCP_PEA_1_T26 (SEQ ID NO: 60) |
| HSACMHCP_PEA_1_P28 | 333 | HSACMHCP_PEA_1_T8 (SEQ ID NO: 56) |
| HSACMHCP_PEA_1_P29 | 334 | HSACMHCP_PEA_1_T14 (SEQ ID NO: 58) |

These sequences are variants of the known protein Myosin heavy chain, cardiac muscle alpha isoform (SEQ ID NO:391) (SwissProt accession identifier MYH6_HUMAN; known also according to the synonyms MyHC-alpha), referred to herein as the previously known protein.

Protein Myosin heavy chain, cardiac muscle alpha isoform (SEQ ID NO:391) is known or believed to have the following function(s): Muscle contraction. The sequence for protein Myosin heavy chain, cardiac muscle alpha isoform is given at the end of the application, as "Myosin heavy chain, cardiac muscle alpha isoform amino acid sequence" (SEQ ID NO:391). Known polymorphisms for this sequence are as shown in Table 4.

TABLE 4

Amino acid mutations for Known Protein

| SNP position(s) on amino acid sequence | Comment |
|---|---|
| 88 | Q -> E |
| 574 | Q -> P |
| 608 | A -> G |
| 744 | T -> A |
| 790 | M -> I |
| 1014 | V -> A |
| 1021 | S -> T |
| 1101 | A -> V |
| 1290 | A -> S |
| 1373 | W -> C |
| 1533 | K -> N |
| 1540 | L -> M |
| 1577-1578 | KL -> NV |
| 1705-1706 | EQ -> DR |
| 1733 | E -> D |
| 1734 | A -> S |
| 1737 | T -> S |
| 1763 | D -> H |
| 1788 | M -> I |
| 1871 | D -> N |
| 1882 | R -> G |
| 1890 | Q -> R |
| 1933 | Missing |

Protein Myosin heavy chain, cardiac muscle alpha isoform (SEQ ID NO:391) localization is believed to be Thick filaments of the myofibrils.

The following GO Annotation(s) apply to the previously known protein. The following annotation(s) were found: muscle contraction; striated muscle contraction; muscle development, which are annotation(s) related to Biological Process; microfilament motor; actin binding; calmodulin binding; ATP binding, which are annotation(s) related to Molecular Function; and muscle myosin; muscle thick filament; myosin, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

The heart-selective diagnostic marker prediction engine provided the following results with regard to cluster HSACMHCP. Predictions were made for selective expression of transcripts of this cluster in heart tissue, according to the previously described methods. The numbers on the y-axis of FIG. 30 refer to weighted expression of ESTs in each category, as "parts per million" (ratio of the expression of ESTs for a particular cluster to the expression of all ESTs in that category, according to parts per million).

Figure 30:
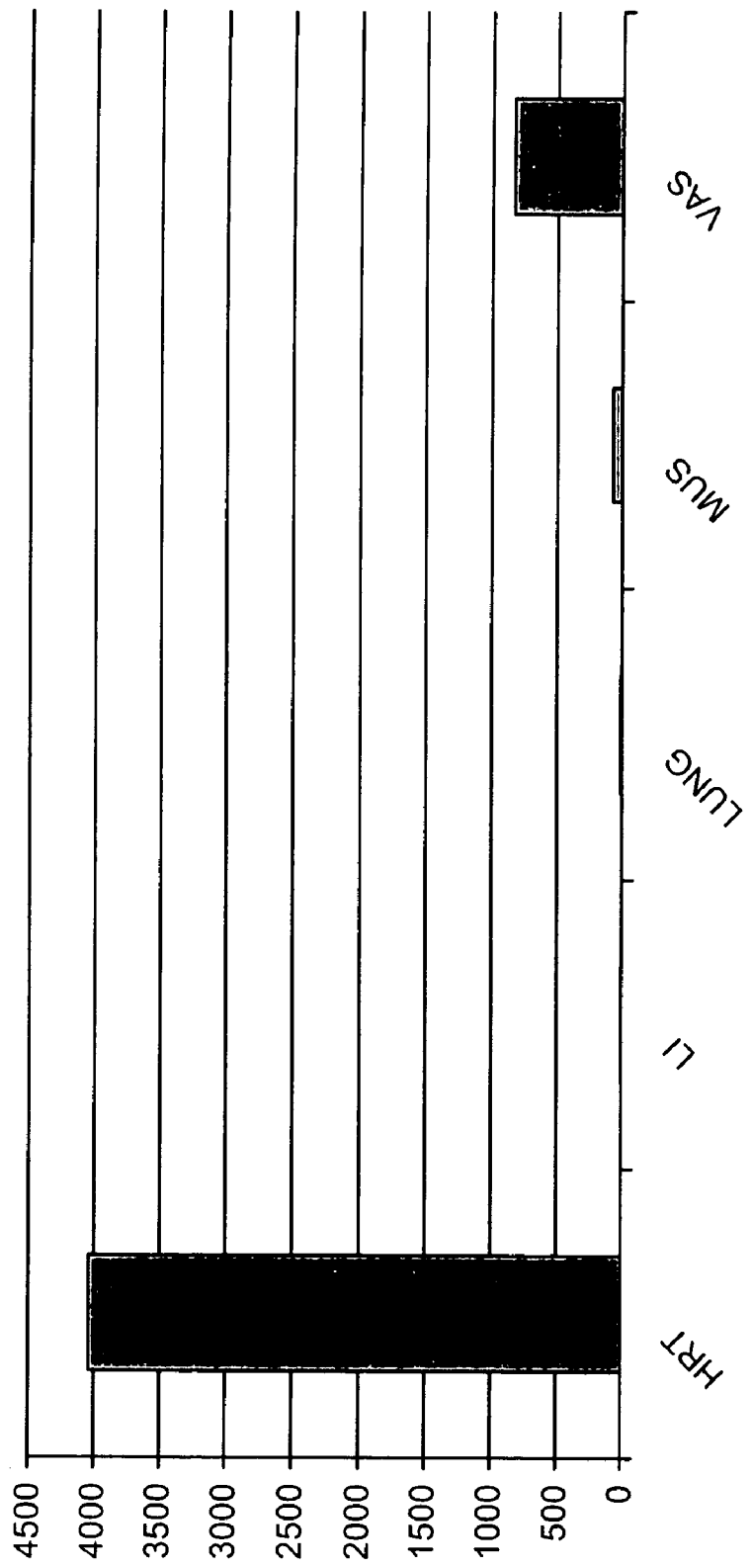
FIG. 30 is a histogram concerning the expression of ESTs in number of heart tissue-specific clones in libraries/sequences.
Figure 31:
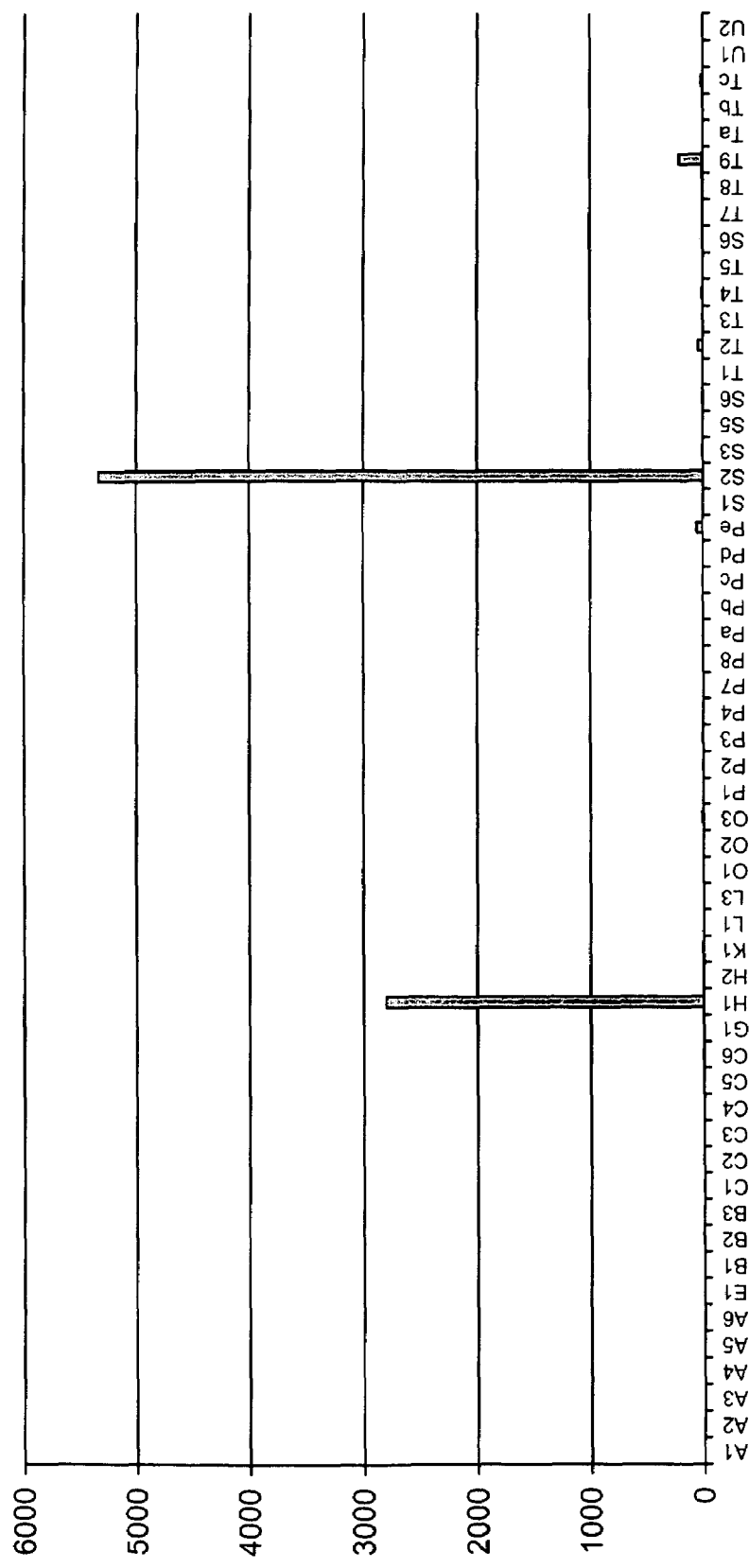
FIG. 31 is a histogram concerning the actual expression of oligonucleotides in various tissues, prob 204737_s_at (SEQ ID NO:392), including heart tissue.
Figure 32:
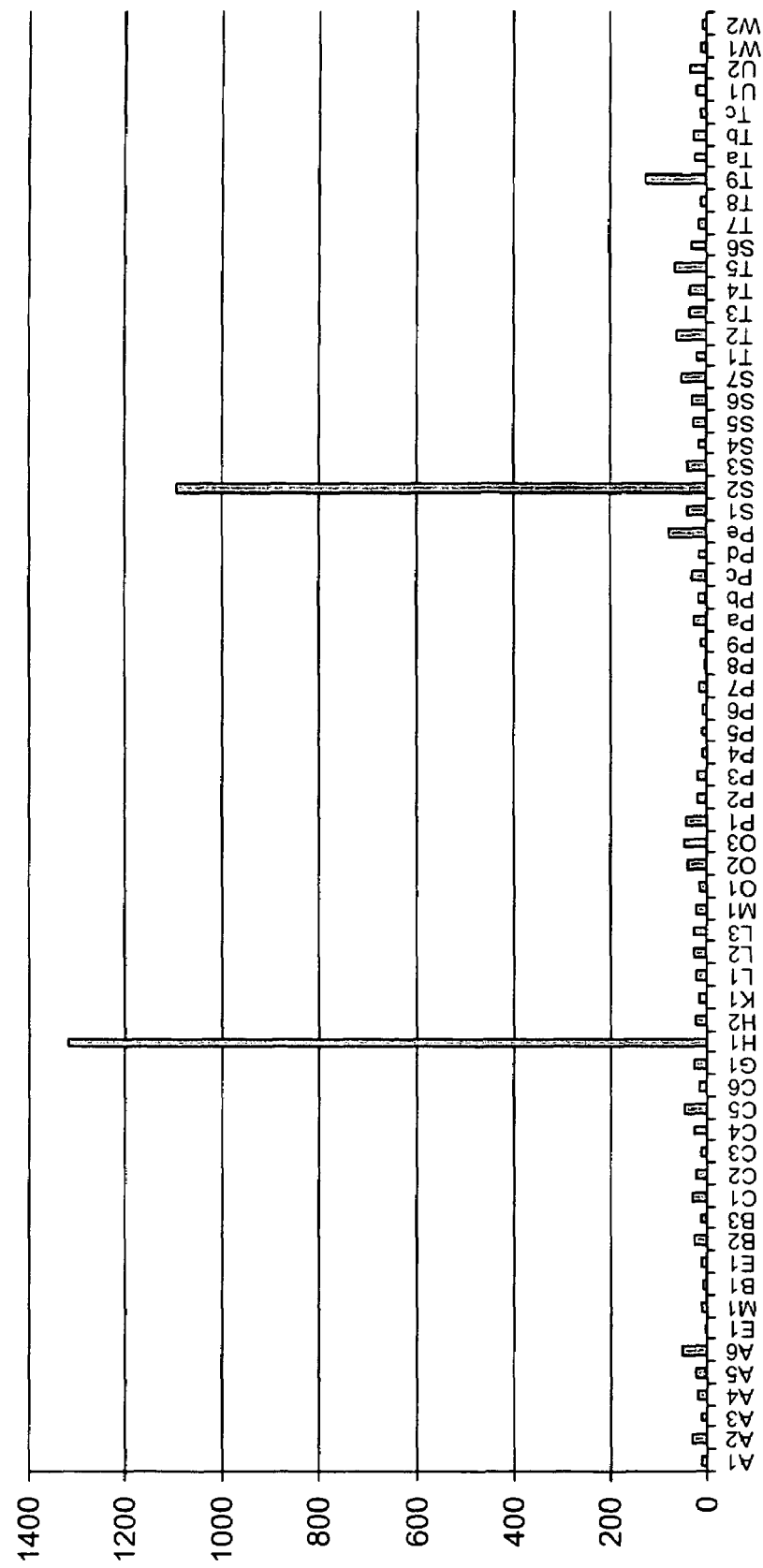
FIG. 32 is a histogram concerning the actual expression of oligonucleotides in various tissues, prob 216265_x_at (SEQ ID NO:392), including heart tissue.

Overall, the following results were obtained as shown with regard to the histogram in FIG. 30, concerning the number of heart-specific clones in libraries/sequences; as well as with regard to the histogram in FIGS. 31-32, concerning the actual expression of oligonucleotides in various tissues, including heart.

This cluster was found to be selectively expressed in heart for the following reasons: in a comparison of the ratio of expression of the cluster in heart specific ESTs to the overall expression of the cluster in non-heart ESTs, which was found to be 24; the ratio of expression of the cluster in heart specific ESTs to the overall expression of the cluster in muscle-specific ESTs which was found to be 92.5; and fisher exact test P-values were computed both for library and weighted clone counts to check that the counts are statistically significant, and were found to be 3.20 E-47.

One particularly important measure of specificity of expression of a cluster in heart tissue is the previously described comparison of the ratio of expression of the cluster in heart as opposed to muscle. This cluster was found to be specifically expressed in heart as opposed to non-heart ESTs as described above. However, many proteins have been shown to be generally expressed at a higher level in both heart and muscle, which is less desirable. For this cluster, as described above, the ratio of expression of the cluster in heart specific ESTs to the overall expression of the cluster in muscle-specific ESTs which was found to be 24, which clearly supports specific expression in heart tissue.

As noted above, cluster HSACMHCP features 10 transcript(s), which were listed in Table 1 above. These transcript(s) encode for protein(s) which are variant(s) of protein Myosin heavy chain, cardiac muscle alpha isoform (SEQ ID NO:391). A description of each variant protein according to the present invention is now provided.

Variant protein HSACMHCP_PEA_1_P2 (SEQ ID NO:326) according to the present invention has an amino acid sequence as given at the end of the application; it is encoded by transcript(s) HSACMHCP_PEA_1_T2 (SEQ ID NO:51). An alignment is given to the known protein (Myosin heavy chain, cardiac muscle alpha isoform (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSACMHCP_PEA_1_P2 (SEQ ID NO:326) and MYH6_HUMAN_V1 (SEQ ID NO:338):

1. An isolated chimeric polypeptide encoding for HSACMHCP_PEA_1_P2 (SEQ ID NO:326), comprising a first amino acid sequence being at least 90% homologous to MTDAQMADFGAAAQYLRKSEKER- LEAQTRPFDIRTECFVPDDKEEFVKAKILSREGGK VIAETENGKTVTVKEDQVLQQNPPKFDK- IEDMAMLTFLHEPAVLFNLKERYAAWMIYT YSGLFCVTVNPYKWLPVYNAEV- VAAYRGKKRSEAPPHIFSISDNAYQYMLTDRENQSI LITGESGAGKTVNTKRVIQYFA- SIAAIGDRGKKDNANANKGTLEDQIIQANPALEAFGN AKTVRNDNSSRFGKFIRIHFGATGKLA- SADIETYLLEKSRVIFQLKAERNYHIFYQILSNK KPELLDMLLVTNNPYDYAFVSQGEVS- VASIDDSEELMATDSAFDVLGFTSEEKAGVYK LTGAIMHYGNMKFKQKQREEQAEP- DGTEDADKSAYLMGLNSADLLKGLCHPRVKVG NEYVTKGQSVQQVYYSIGALAKAVYEKM- FNWMVTRINATLETKQPRQYFIGVLDIAGF EIFDFNS- FEQLCINFTNEKLQQFFNHHMFV- LEQEEYKKEGIEWTFIDFGMDLQACIDLIEK PMGIMSILEEECMFPKATDMTFKAKLYD- NHLGKSNNFQKPRNIKGKQEAHFSLIHYAGT VDY- NILGWLEKNKDPLNETVVALYQKSSLKL- MATLFSSYATADTGDSGKSKGGKKKG SSFQTVSALHRENLNKLMTNLRTTHPH- FVRCIIPNERKAPGVMDNPLVMHQLRCNGVL EGIRI- CRKGFPNRILYGDFRQRYRILN- PVAIPEGQFIDSRKGTEKLLSSLDIDHNQYKFGH TKVFFKAGLLGLLEEMRDERLSRIITRM- QAQARGQLMRIEFKKIVERRDALLVIQWNIR AFMGVKNWPWMKLYFKIKPLLKSA- ETEKEMATMKEEFGRIKETLEKSEARRKELEEK MVSLLQEKNDLQLQVQAEQDNLNDAEERCDQLIKNKIQLEAKVKEMNERLEDEEEMN AELTAKKRKLEDECSELKKDIDDLELTLAKVEKEKHATENKVKNLTEEMAGLDEIIAKL TKEKKALQEAHQQALDDLQVEEDKVNSLSKSKVKLEQQVDDLEGSLEQEKKVRMDLE RAKRKLEGDLKLTQESIMDLENDKLQLEEKLKKKEFDINQQNSKIEDEQALALQLQKK LKENQARIEELEEELEAERTARAKVEKLRSDLSRELEEISERLEEAGGGATSVQIEMNKKR EAEFQKMRRDLEEATLQHEATAAALRKKHADSVAELGEQIDNLQRVKQKLEKEKSEF KLELDDVTSNMEQIIKAKANLEKVSRTLEDQANEYRVKLEEAQRSLNDFTTQRAKLQT ENGELARQLEEKEALISQLTRGKLSYTQQMEDLKRQLEEEGKAKNALAHALQSARHDC DLLREQYEEETEAKAELQRVLSKANSEVAQWRTKYETDAIQRTEELEEAKKKLAQRLQ DAEEAVEAVNAKCSSLEKTKHRLQNEIEDLMVDVERSNAAAAALDKKQRNFDKILAE WKQKYEESQSELESSQKEARSLSTELFKLKNAYEESLEHLETFKRENKNLQEEISDLTEQ LGEGGKNVHELEKVRKQLEVEKLELQSALEEAEASLEHEEGKILRAQLEFNQIKAEIER KLAEKDEEMEQAKRNHQRVVDSLQTSLDAETRSRNEVLRVKKKMEGDLNEMEIQLSH ANRMAAEAQKQVKSLQSLLKDTQIQLDDAVRANDDLKENIAIVERRNNLLQAELEELR AVVEQTERSRKLAEQELIETSERVQLLHSQNTSLINQKKKMESDLTQLQSEVEEAVQEC RNAEEKAKKAITDAAMMAEELKKEQDTSAHLERMKKNMEQTIKDLQHRLDEAEQIAL KGGKKQLQKLEARVRELEGELEAEQKRNAESVKGMRKSERRIKELTYQ corresponding to amino acids 1-1855 of MYH6_HUMAN_V1 (SEQ ID NO:338), which also corresponds to amino acids 1-1855 of HSACMHCP_PEA_1_P2 (SEQ ID NO:326), and a second amino acid sequence being at least 70%, optionally at least 80%, preferably at least 85%, more preferably at least 90% and most preferably at least 95% homologous to a polypeptide having the sequence VRRTPDTGSRCGSFFSGPTAPPSQGSSHLLLEMLLVDLTFFSRSAVSLT (SEQ ID NO:394) corresponding to amino acids 1856-1904 of HSACMHCP_PEA_1_P2 (SEQ ID NO:326), wherein said first amino acid sequence and second amino acid sequence are contiguous and in a sequential order.

2. An isolated polypeptide encoding for a tail of HSACMHCP_PEA_1_P2 (SEQ ID NO:326), comprising a polypeptide being at least 70%, optionally at least about 80%, preferably at least about 85%, more preferably at least about 90% and most preferably at least about 95% homologous to the sequence VRRTPDTGSRCGSFFSGPTAPPSQGSSHLLLEMLLVDLTFFSRSAVSLT (SEQ ID NO:394) in HSACMHCP_PEA_1_P2 (SEQ ID NO:326).

It should be noted that the known protein sequence (MYH6_HUMAN; SEQ ID NO:391) has one or more changes than the sequence given at the end of the application and named as being the amino acid sequence for MYH6_HUMAN_V1 (SEQ ID NO:338). These changes were previously known to occur and are listed in the table below.

TABLE 5

Changes to MYH6_HUMAN_V1 (SEQ ID NO: 338)

| SNP position(s) on amino acid sequence | Type of change |
|---|---|
| 89 | conflict |
| 1735 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HSACMHCP_PEA_1_P2 (SEQ ID NO:326) is encoded by the following transcript(s): HSACMHCP_PEA_1_T2 (SEQ ID NO:51), for which the sequence(s) is/are given at the end of the application. The coding portion of transcript HSACMHCP_PEA_1_T2 (SEQ ID NO:51) is shown in bold; this coding portion starts at position 78 and ends at position 5789. The transcript also has the following SNPs as listed in Table 6 (given according to their position on the nucleotide sequence, with the alternative nucleic acid listed; the last column indicates whether the SNP is known or not; the presence of known SNPs in variant protein HSACMHCP_PEA_1_P2 (SEQ ID NO:326) sequence provides support for the deduced sequence of this variant protein according to the present invention).

TABLE 6

Nucleic acid SNPs

| SNP position on nucleotide sequence | Alternative nucleic acid | Previously known SNP? |
|---|---|---|
| 339 | G -> C | Yes |
| 488 | A -> G | Yes |
| 504 | A -> C | Yes |
| 887 | G -> A | Yes |
| 1204 | C -> A | Yes |
| 1205 | A -> C | Yes |
| 1232 | G -> T | No |
| 1696 | T -> G | No |
| 2424 | C -> A | Yes |
| 2910 | C -> T | Yes |
| 3379 | C -> T | Yes |
| 3465 | G -> A | No |
| 4066 | C -> | No |
| 4088 | G -> A | Yes |
| 4391 | T -> C | Yes |
| 4394 | T -> C | Yes |
| 4991 | C -> T | No |
| 5057 | C -> T | Yes |
| 5279 | G -> T | Yes |
| 5282 | T -> C | Yes |
| 5286 | A -> T | Yes |
| 5336 | C -> T | Yes |
| 5664 | G -> A | Yes |
| 6141 | C -> T | Yes |
| 7365 | T -> C | Yes |
| 7432 | G -> T | Yes |
| 7665 | A -> G | Yes |
| 8268 | C -> G | Yes |
| 8468 | G -> A | No |
| 8491 | G -> A | Yes |
| 8534 | C -> T | Yes |

Variant protein HSACMHCP_PEA_1_P3 (SEQ ID NO:327) according to the present invention has an amino acid sequence as given at the end of the application; it is encoded by transcript(s) HSACMHCP_PEA_1_T3 (SEQ ID NO:52). An alignment is given to the known protein (Myosin heavy chain, cardiac muscle alpha isoform (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSACMHCP_PEA_1_P3 (SEQ ID NO:327) and MYH6_HUMAN_V2 (SEQ ID NO:339):

1. An isolated chimeric polypeptide encoding for HSACMHCP_PEA_1_P3 (SEQ ID NO:327), comprising a first amino acid sequence being at least 90% homologous to MTDAQMADFGAAAQYLRKSEKER-LEAQTRPFDIRTECFVPDDKEEFVKAKILSREGGK VIAETENGKTVTVKEDQVLQQNPPKFDK-IEDMAMLTFLHEPAVLFNLKERYAAWMIYT YSGLFCVTVNPYKWLPVYNAEV-VAAYRGKKRSEAPPHIFSISDNAYQYMLTDRENQSI LITGESGAGKTVNTKRVIQYFA-SIAAIGDRGKKDNANANKGTLEDQIIQANPALEAFGN AKTVRNDNSSRFGKFIRIHFGATGKLA-SADIETYLLEKSRVIFQLKAERNYHIFYQILSNK KPELLDMLLVTNNPYDYAFVSQGEVS-VASIDDSEELMATDSAFDVLGFTSEEKAGVYK LTGAIMHYGNMKFKQKQREEQAEP-DGTEDADKSAYLMGLNSADLLKGLCHPRVKVG NEYVTKGQSVQQVYYSIGALAKAVYEKM-FNWMVTRINATLETKQPRQYFIGVLDIAGF EIFDFNS-FEQLCINFTNEKLQQFFNHHMFV-LEQEEYKKEGIEWTFIDFGMDLQACIDLIEK PMGIMSILEEECMFPKATDMTFKAKLYD-NHLGKSNNFQKPRNIKGKQEAHFSLIHYAGT VDY-NILGWLEKNKDPLNETVVALYQKSSLKL-MATLFSSYATADTGDSGKSKGGKKKG SSFQTVSALHRENLNKLMTNLRTTHPH-FVRCIIPNERKAPGVMDNPLVMHQLRCNGVL EGIRI-CRKGFPNRILYGDFRQRYRILN-PVAIPEGQFIDSRKGTEKLLSSLDIDHNQYKFGH TKVFFKAGLLGLLEEMRDERLSRIITRM-QAQARGQLMRIEFKKIVERRDALLVIQWNIR AFMGVKNWPWMKLYFKIKPLLKSA-ETEKEMATMKEEFGRIKETLEKSEARRKELEEK MVSLLQEKNDLQLQVQAEQDNLNDAEER-CDQLIKNKIQLEAKVKEMNERLEDEEEMN AELTAKKRKLEDECSELKKDIDDLELT-LAKVEKEKHATENKVKNLTEEMAGLDEIIAKL TKEKKALQEAHQQALDDLQVEEDKVNSL-SKSKVKLEQQVDDLEGSLEQEKKVRMDLE RAKRKLEGDLKLTQESIMDLEND-KLQLEEKLKKKEFDINQQNSKIEDEQALALQLQKK LKENQARIEELEEELEAERTARAKVEKL-RSDLSRELEEISERLEEAGGATSVQIEMNKKR EAEFQKMRRDLEEATLQHEATAAAL-RKKHADSVAELGEQIDNLQRVKQKLEKEKSEF KLELDDVTSNMEQIIKAKANLEKVSR-TLEDQANEYRVKLEEAQRSLNDFTTQRAKLQT ENGELARQLEEKEALISQLTRGKL-SYTQQMEDLKRQLEEEGK corresponding to amino acids 1-1326 of MYH6_HUMAN_V2 (SEQ ID NO:339), which also corresponds to amino acids 1-1326 of HSACMHCP_PEA_1_P3 (SEQ ID NO:327), and a second amino acid sequence being at least 70%, optionally at least 80%, preferably at least 85%, more preferably at least 90% and most preferably at least 95% homologous to a polypeptide having the sequence VRPSGEGGQA (SEQ ID NO:431) corresponding to amino acids 1327-1336 of HSACMHCP_PEA_1_P3 (SEQ ID NO:327), wherein said first amino acid sequence and second amino acid sequence are contiguous and in a sequential order.

2. An isolated polypeptide encoding for a tail of HSACMHCP_PEA_1_P3 (SEQ ID NO:327), comprising a polypeptide being at least 70%, optionally at least about 80%, preferably at least about 85%, more preferably at least about 90% and most preferably at least about 95% homologous to the sequence VRPSGEGGQA (SEQ ID NO:431) in HSACMHCP_PEA_1_P3 (SEQ ID NO:327).

It should be noted that the known protein sequence (MYH6_HUMAN (SEQ ID NO:391)) has one or more changes than the sequence given at the end of the application and named as being the amino acid sequence for MYH6_HUMAN_V2 (SEQ ID NO:339). These changes were previously known to occur and are listed in the table below.

TABLE 7

| Changes to MYH6_HUMAN_V2 (SEQ ID NO: 339) | |
|---|---|
| SNP position(s) on amino acid sequence | Type of change |
| 89 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HSACMHCP_PEA_1_P3 (SEQ ID NO:327) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein HSACMHCP_PEA_1_P3 (SEQ ID NO:327) sequence provides support for the deduced sequence of this variant protein according to the present invention).

TABLE 8

| Amino acid mutations | | |
|---|---|---|
| SNP position(s) on amino acid sequence | Alternative amino acid(s) | Previously known SNP? |
| 88 | E -> Q | Yes |
| 376 | P -> Q | Yes |
| 540 | M -> R | No |
| 783 | L -> M | Yes |
| 1101 | A -> V | Yes |
| 1130 | A -> T | No |

Variant protein HSACMHCP_PEA_1_P3 (SEQ ID NO:327) is encoded by the following transcript(s): HSACMHCP_PEA_1_T3 (SEQ ID NO:52), for which the sequence(s) is/are given at the end of the application. The coding portion of transcript HSACMHCP_PEA_1_T3 (SEQ ID NO:52) is shown in bold; this coding portion starts at position 78 and ends at position 4085. The transcript also has the following SNPs as listed in Table 9 (given according to their position on the nucleotide sequence, with the alternative nucleic acid listed; the last column indicates whether the SNP is known or not; the presence of known SNPs in variant protein HSACMHCP_PEA_1_P3 (SEQ ID NO:327) sequence provides support for the deduced sequence of this variant protein according to the present invention).

TABLE 9

Nucleic acid SNPs

| SNP position on nucleotide sequence | Alternative nucleic acid | Previously known SNP? |
|---|---|---|
| 339 | G -> C | Yes |
| 488 | A -> G | Yes |
| 504 | A -> C | Yes |
| 887 | G -> A | Yes |
| 1204 | C -> A | Yes |
| 1205 | A -> C | Yes |
| 1232 | G -> T | No |
| 1696 | T -> G | No |
| 2424 | C -> A | Yes |
| 2910 | C -> T | Yes |
| 3379 | C -> T | Yes |
| 3465 | G -> A | No |
| 4403 | C -> | No |
| 4425 | G -> A | Yes |
| 4728 | T -> C | Yes |
| 4731 | T -> C | Yes |
| 5328 | C -> T | No |
| 5394 | C -> T | Yes |
| 5616 | G -> T | Yes |
| 5619 | T -> C | Yes |
| 5623 | A -> T | Yes |
| 5673 | C -> T | Yes |

Variant protein HSACMHCP_PEA_1_P4 (SEQ ID NO:328) according to the present invention has an amino acid sequence as given at the end of the application; it is encoded by transcript(s) HSACMHCP_PEA_1_T4 (SEQ ID NO:53). An alignment is given to the known protein (Myosin heavy chain, cardiac muscle alpha isoform (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSACMHCP_PEA_1_P4 (SEQ ID NO:328) and MYH6_HUMAN_V2 (SEQ ID NO:339):

1. An isolated chimeric polypeptide encoding for HSACMHCP_PEA_1_P4 (SEQ ID NO:328), comprising a first amino acid sequence being at least 90% homologous to MTDAQMADFGAAAQYLRKSEKER-LEAQTRPFDIRTECFVPDDKEEFVKAKILSREGGK VIAETENGKTVTVKEDQVLQQNPPKFDK-IEDMAMLTFLHEPAVLFNLKERYAAWMIYT YSGLFCVTVNPYKWLPVYNAEV-VAAYRGKKRSEAPPHIFSISDNAYQYMLTDRENQSI LITGESGAGKTVNTKRVIQYFA-SIAAIGDRGKKDNANANKGTLEDQIIQANPALEAFGN AKTVRNDNSSRFGKFIRIHFGATGKLA-SADIETYLLEKSRVIFQLKAERNYHIFYQILSNK KPELLDMLLVTNNPYDYAFVSQGEVS-VASIDDSEELMATDSAFDVLGFTSEEKAGVYK LTGAIMHYGNMKFKQKQREEQAEP-DGTEDADKSAYLMGLNSADLLKGLCHPRVKVG NEYVTKGQSVQQVYYSIGALAKAVYEKM-FNWMVTRINATLETKQPRQYFIGVLDIAGF EIFDFNS-FEQLCINFTNEKLQQFFNHHMFV-LEQEEYKKEGIEWTFIDFGMDLQACIDLIEK PMGIMSILEEECMFPKATDMTFKAKLYD-NHLGKSNNFQKPRNIKGKQEAHFSLIHYAGT VDY-NILGWLEKNKDPLNETVVALYQKSSLKL-MATLFSSYATADTGDSGKSKGGKKKG SSFQTVSALHRENLNKLMTNLRTTHPH-FVRCIIPNERKAPGVMDNPLVMHQLRCNGVL EGIRI-CRKGFPNRILYGDFRQRYRILN-PVAIPEGQFIDSRKGTEKLLSSLDIDHNQYKFGH TKVFFKAGLLGLLEEMRDERLSRIITRM-QAQARGQLMRIEFKKIVERRDALLVIQWNIR AFMGVKNWPWMKLYFKIKPLLKSA-ETEKEMATMKEEFGRIKETLEKSEARRKELEEK MVSLLQEKNDLQLQVQAEQDNLNDAEER-CDQLIKNKIQLEAKVKEMNERLEDEEEMN AELTAKKRKLEDECSELKKDIDDLELT-LAKVEKEKHATENKVKNLTEEMAGLDEIIAKL TKEKKALQEAHQQALDDLQVEEDKVNSL-SKSKVKLEQQVDDLEGSLEQEKKVRMDLE RAKRKLEGDLKLTQESIMDLEND-KLQLEEKLKKKEFDINQQNSKIEDEQALALQLQKK LKENQARIEELEEELEAERTARAKVEKL-RSDLSRELEEISERLEEAGGATSVQIEMNKKR EAEFQKMRRDLEEATLQHEATAAAL-RKKHADSVAELGEQIDNLQRVKQKLEKEKSEF KLELDDVTSNMEQIIKAKANLEKVSR-TLEDQANEYRVKLEEAQRSLNDFTTQRAKLQT ENGELARQLEEKEALISQLTRGKL-SYTQQMEDLKRQLEEEGKAKNALAHALQSARHDC DLLREQYEEETEAKAELQRVLS-KANSEVAQWRTKYETDAIQRTEELEEAKKKLAQRLQ DAEEAVEAVNAKCSSLEKTKHRLQ-NEIEDLMVDVERSNAAAAALDKKQRNFDKILAE WKQKYEESQSELESSQKEARSL-STELFKLKNAYEESLEHLETFKRENKNLQ corresponding to amino acids 1-1508 of MYH6_HUMAN_V2 (SEQ ID NO:339), which also corresponds to amino acids 1-1508 of HSACMHCP_PEA_1_P4 (SEQ ID NO:328), and a second amino acid sequence being at least 70%, optionally at least 80%, preferably at least 85%, more preferably at least 90% and most preferably at least 95% homologous to a polypeptide having the sequence GVLGVQEARDELVGGRAM-QGQGEHRL (SEQ ID NO:432) corresponding to amino acids 1509-1534 of HSACMHCP_PEA_1_P4 (SEQ ID NO:328), wherein said first amino acid sequence and second amino acid sequence are contiguous and in a sequential order.

2. An isolated polypeptide encoding for a tail of HSACMHCP_PEA_1_P4 (SEQ ID NO:328), comprising a polypeptide being at least 70%, optionally at least about 80%, preferably at least about 85%, more preferably at least about 90% and most preferably at least about 95% homologous to the sequence GVLGVQEARDELVGGRAM-QGQGEHRL (SEQ ID NO:432) in HSACMHCP_PEA_1_P4 (SEQ ID NO:328).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HSACMHCP_PEA_1_P4 (SEQ ID NO:328) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein HSACMHCP_PEA_1_P4 (SEQ ID NO:328) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 88 | E -> Q | Yes |
| 376 | P -> Q | Yes |
| 540 | M -> R | No |
| 783 | L -> M | Yes |
| 1101 | A -> V | Yes |
| 1130 | A -> T | No |
| 1330 | A -> | No |

Variant protein HSACMHCP_PEA_1_P4 (SEQ ID NO:328) is encoded by the following transcript(s): HSACMHCP_PEA_1_T4 (SEQ ID NO:53), for which the sequence(s) is/are given at the end of the application. The coding portion of transcript HSACMHCP_PEA_1_T4 (SEQ ID NO:53) is shown in bold; this coding portion starts at position 78 and ends at position 4679. The transcript also has the following SNPs as listed in Table 12 (given according to their position on the nucleotide sequence, with the alternative nucleic acid listed; the last column indicates whether the SNP is known or not; the presence of known SNPs in variant protein HSACMHCP_PEA_1_P4 (SEQ ID NO:328) sequence provides support for the deduced sequence of this variant protein according to the present invention).

TABLE 12

| Nucleic acid SNPs | | |
|---|---|---|
| SNP position on nucleotide sequence | Alternative nucleic acid | Previously known SNP? |
| 339 | G -> C | Yes |
| 488 | A -> G | Yes |
| 504 | A -> C | Yes |
| 887 | G -> A | Yes |
| 1204 | C -> A | Yes |
| 1205 | A -> C | Yes |
| 1232 | G -> T | No |
| 1696 | T -> G | No |
| 2424 | C -> A | Yes |
| 2910 | C -> T | Yes |
| 3379 | C -> T | Yes |
| 3465 | G -> A | No |
| 4066 | C -> | No |
| 4088 | G -> A | Yes |
| 4391 | T -> C | Yes |
| 4394 | T -> C | Yes |
| 4673 | T -> C | Yes |
| 5095 | C -> T | No |
| 5161 | C -> T | Yes |
| 5383 | G -> T | Yes |

TABLE 12-continued

| Nucleic acid SNPs | | |
|---|---|---|
| SNP position on nucleotide sequence | Alternative nucleic acid | Previously known SNP? |
| 5386 | T -> C | Yes |
| 5390 | A -> T | Yes |
| 5440 | C -> T | Yes |

Variant protein HSACMHCP_PEA_1_P6 (SEQ ID NO:329) according to the present invention has an amino acid sequence as given at the end of the application; it is encoded by transcript(s) HSACMHCP_PEA_1_T7 (SEQ ID NO:55). An alignment is given to the known protein (Myosin heavy chain, cardiac muscle alpha isoform (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSACMHCP_PEA_1_P6 (SEQ ID NO:329) and MYH6_HUMAN_V1 (SEQ ID NO:338):

1. An isolated chimeric polypeptide encoding for HSACMHCP_PEA_1_P6 (SEQ ID NO:329), comprising a first amino acid sequence being at least 90% homologous to MTDAQMADFGAAAQYLRKSEKER-
LEAQTRPFDIRTECFVPDDKEEFVKAKILSREGGK
VIAETENGKTVTVKEDQVLQQNPPKFDK-
IEDMAMLTFLHEPAVLFNLKERYAAWMIYT
YSGLFCVTVNPYKWLPVYNAEV-
VAAYRGKKRSEAPPHIFSISDNAYQYMLTDRENQSI
LITGESGAGKTVNTKRVIQYFA-
SIAAIGDRGKKDNANANKGTLEDQIIQANPALEAFGN
AKTVRNDNSSRFGKFIRIHFGATGKLA-
SADIETYLLEKSRVIFQLKAERNYHIFYQILSNK
KPELLDMLLVTNNPYDYAFVSQGEVS-
VASIDDSEELMATDSAFDVLGFTSEEKAGVYK
LTGAIMHYGNMKFKQKQREEQAEP-
DGTEDADKSAYLMGLNSADLLKGLCHPRVKVG
NEYVTKGQSVQQVYYSIGALAKAVYEKM-
FNWMVTRINATLETKQPRQYFIGVLDIAGF EIFDFNS-
FEQLCINFTNEKLQQFFNHHMFV-
LEQEEYKKEGIEWTFIDFGMDLQACIDLIEK
PMGIMSILEEECMFPKATDMTFKAKLYD-
NHLGKSNNFQKPRNIKGKQEAHFSLIHYAGT VDY-
NILGWLEKNKDPLNETVVALYQKSSLKL-
MATLFSSYATADTGDSGKSKGGKKKG
SSFQTVSALHRENLNKLMTNLRTTHPH-
FVRCIIPNERKAPGVMDNPLVMHQLRCNGVL EGIRI-
CRKGFPNRILYGDFRQRYRILN-
PVAIPEGQFIDSRKGTEKLLSSLDIDHNQYKFGH
TKVFFKAGLLGLLEEMRDERLSRIITRM-
QAQARGQLMRIEFKKIVERRDALLVIQWNIR
AFMGVKNWPWMKLYFKIKPLLKSA-
ETEKEMATMKEEFGRIKETLEKSEARRKELEEK
MVSLLQEKNDLQLQVQAEQDNLNDAEER-
CDQLIKNKIQLEAKVKEMNERLEDEEEMN
AELTAKKRKLEDECSELKKDIDDLELT-
LAKVEKEKHATENKVKNLTEEMAGLDEIIAKL
TKEKKALQEAHQQALDDLQVEEDKVNSL-
SKSKVKLEQQVDDLEGSLEQEKKVRMDLE
RAKRKLEGDLKLTQESIMDLEND-
KLQLEEKLKKKEFDINQQNSKIEDEQALALQLQKK LKENQARIEELEEELEAERTARAKVEKL-
RSDLSRELEEISERLEEAGGATSVQIEMNKKR
EAEFQKMRRDLEEATLQHEATAAAL-
RKKHADSVAELGEQIDNLQRVKQKLEKEKSEF
KLELDDVTSNMEQIIKAKANLEKVSR-
TLEDQANEYRVKLEEAQRSLNDFTTQRAKLQT
ENGELARQLEEKEALISQLTRGKL-
SYTQQMEDLKRQLEEEGKAKNALAHALQSARHDC
DLLREQYEEETEAKAELQRVLS-
KANSEVAQWRTKYETDAIQRTEELEEAKKKLAQRLQ
DAEEAVEAVNAKCSSLEKTKHRLQ-
NEIEDLMVDVERSNAAAAALDKKQRNFDKILAE
WKQKYEESQSELESSQKEARSL-
STELFKLKNAYEESLEHLETFKRENKNLQEEISDLTEQ
LGEGGKNVHELEKVRKQLEVEKLELQSA-
LEEAEASLEHEEGKILRAQLEFNQIKAEIER
KLAEKDEEMEQAKRNHQRVVD-
SLQTSLDAETRSRNEVLRVKKKMEGDLNEMEIQLSH
ANRMAAEAQKQVKSLQSLLKDTQIQLD-
DAVRANDDLKENIAIVERRNNLLQAELEELR
AVVEQTERSRKLAEQELIETSERVQLLH-
SQNTSLINQKKKMESDLTQLQSEVEEAVQEC
RNAEEKAKKAITD corresponding to amino acids 1-1763 of MYH6_HUMAN_V 1 (SEQ ID NO:338), which also corresponds to amino acids 1-1763 of HSACMHCP_PEA_1_P6 (SEQ ID NO:329), and a second amino acid sequence being at least 70%, optionally at least 80%, preferably at least 85%, more preferably at least 90% and most preferably at least 95% homologous to a polypeptide having the sequence VSDRPPSASPKDRNKALGPGQATVL (SEQ ID NO:432) corresponding to amino acids 1764-1788 of HSACMHCP_PEA_1_P6 (SEQ ID NO:329), wherein said first amino acid sequence and second amino acid sequence are contiguous and in a sequential order.

2. An isolated polypeptide encoding for a tail of HSACMHCP_PEA_1_P6 (SEQ ID NO:329), comprising a polypeptide being at least 70%, optionally at least about 80%, preferably at least about 85%, more preferably at least about 90% and most preferably at least about 95% homologous to the sequence VSDRPPSASPKDRNKALGPGQATVL (SEQ ID NO:432) in HSACMHCP_PEA_1_P6 (SEQ ID NO:329).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HSACMHCP_PEA_1_P6 (SEQ ID NO:329) also has the following non-silent SNPs (Single Nucleotide Polymorphisms) as listed in Table 14, (given according to their position(s) on the amino acid sequence, with the alternative amino acid(s) listed; the last column indicates whether the SNP is known or not; the presence of known SNPs in variant protein HSACMHCP_PEA_1_P6 (SEQ ID NO:329) sequence provides support for the deduced sequence of this variant protein according to the present invention).

TABLE 14

Amino acid mutations

| SNP position(s) on amino acid sequence | Alternative amino acid(s) | Previously known SNP? |
|---|---|---|
| 88 | E -> Q | Yes |
| 376 | P -> Q | Yes |
| 540 | M -> R | No |
| 783 | L -> M | Yes |
| 1101 | A -> V | Yes |
| 1130 | A -> T | No |
| 1330 | A -> | No |
| 1737 | T -> S | Yes |

Variant protein HSACMHCP_PEA_1_P6 (SEQ ID NO:329) is encoded by the following transcript(s): HSACMHCP_PEA_1_T7 (SEQ ID NO:55), for which the sequence(s) is/are given at the end of the application. The coding portion of transcript HSACMHCP_PEA_1_T7 (SEQ ID NO:55) is shown in bold; this coding portion starts at position 78 and ends at position 5441. The transcript also has the following SNPs as listed in Table 15 (given according to their position on the nucleotide sequence, with the alternative nucleic acid listed; the last column indicates whether the SNP is known or not; the presence of known SNPs in variant protein HSACMHCP_PEA_1_P6 (SEQ ID NO:329) sequence provides support for the deduced sequence of this variant protein according to the present invention).

TABLE 15

Nucleic acid SNPs

| SNP position on nucleotide sequence | Alternative nucleic acid | Previously known SNP? |
|---|---|---|
| 339 | G -> C | Yes |
| 488 | A -> G | Yes |
| 504 | A -> C | Yes |
| 887 | G -> A | Yes |
| 1204 | C -> A | Yes |
| 1205 | A -> C | Yes |
| 1232 | G -> T | No |
| 1696 | T -> G | No |
| 2424 | C -> A | Yes |
| 2910 | C -> T | Yes |
| 3379 | C -> T | Yes |
| 3465 | G -> A | No |
| 4066 | C -> | No |
| 4088 | G -> A | Yes |
| 4391 | T -> C | Yes |
| 4394 | T -> C | Yes |
| 4991 | C -> T | No |
| 5057 | C -> T | Yes |
| 5279 | G -> T | Yes |
| 5282 | T -> C | Yes |
| 5286 | A -> T | Yes |
| 5336 | C -> T | Yes |
| 5862 | G -> A | Yes |
| 6339 | C -> T | Yes |
| 7563 | T -> C | Yes |
| 7630 | G -> T | Yes |
| 7863 | A -> G | Yes |
| 8466 | C -> G | Yes |
| 8666 | G -> A | No |
| 8689 | G -> A | Yes |
| 8732 | C -> T | Yes |

Variant protein HSACMHCP_PEA_1_P12 (SEQ ID NO:330) according to the present invention has an amino acid sequence as given at the end of the application; it is encoded by transcript(s) HSACMHCP_PEA_1_T13 (SEQ ID NO:57). An alignment is given to the known protein (Myosin heavy chain, cardiac muscle alpha isoform (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSACMHCP_PEA__1_P12 (SEQ ID NO:330) and MYH6_HUMAN_V3 (SEQ ID NO:340):

1. An isolated chimeric polypeptide encoding for HSACMHCP_PEA__1_P12 (SEQ ID NO:330), comprising a first amino acid sequence being at least 70%, optionally at least 80%, preferably at least 85%, more preferably at least 90% and most preferably at least 95% homologous to a polypeptide having the sequence MGLWKPGSVLSDSLFASSPCPQ (SEQ ID NO:395) corresponding to amino acids 1-22 of HSACMHCP_PEA__1_P12 (SEQ ID NO:330), and a second amino acid sequence being at least 90% homologous to PMGIMSILEEECMFPKATDMTFKAKLYDNHLGKSNNFQKPRNIKGKQEAHFSLIHYAGT VDYNILGWLEKNKDPLNETVVALYQKSSLKLMATLFSSYATADTGDSGKSKG GKKKG SSFQTVSALHRENLNKLMTNLRTTHPHFVRCIIPNERKAPGVMDNPLVMHQLRCNGVL EGIRICRKGFPNRILYGDFRQRYRILNPVAIPEGQFIDSRKGTEKLLSSLDIDHNQYKFGH TKVFFKAGLLGLLEEMRDERLSRIITRMQAQARGQLMRIEFKKIVERRDALLVIQWNIR AFMGVKNWPWMKLYFKIKPLLKSAETEKEMATMKEEFGRIKETLEKSEARRKELEEK MVSLLQEKNDLQLQVQAEQDNLNDAEERCDQLIKNKIQLEAKVKEMNERLEDEEEMN AELTAKKRKLEDECSELKKDIDDLELTLAKVEKEKHATENKVKNLTEEMAGLDEIIAKL TKEKKALQEAHQQALDDLQVEEDKVNSLSKSKVKLEQQVDDLEGSLEQEKKVRMDLE RAKRKLEGDLKLTQESIMDLENDKLQLEEKLKKKEFDINQQNSKIEDEQALALQLQKK LKENQARIEELEEELEAERTARAKVEKLRSDLSRELEEISERLEEAGGATSVQIEMNKKR EAEFQKMRRDLEEATLQHEATAAALRKKHADSVAELGEQIDNLQRVKQKLEKEKSEF KLELDDVTSNMEQIIKAKANLEKVSRTLEDQANEYRVKLEEAQRSLNDFTTQRAKLQT ENGELARQLEEKEALISQLTRGKLSYTQQMEDLKRQLEEEGKAKNALAHALQSARHDC DLLREQYEEETEAKAELQRVLSKANSEVAQWRTKYETDAIQRTEELEEAKKKLAQRLQ DAEEAVEAVNAKCSSLEKTKHRLQNEIEDLMVDVERSNAAAAALDKKQRNFDKILAE WKQKYEESQSELESSQKEARSLSTELFKLKNAYEESLEHLETFKRENKNLQEEISDLTEQ LGEGGKNVHELEKVRKQLEVEKLELQSALEEAEASLEHEEGKILRAQLEFNQIKAEIER KLAEKDEEMEQAKRNHQRVVDSLQTSLDAETRSRNEVLRVKKKMEGDLNEMEIQLSH ANRMAAEAQKQVKSLQSLLKDTQIQLDDAVRANDDLKENIAIVERRNNLLQAELEELR AVVEQTERSRKLAEQELIETSERVQLLHSQNTSLINQKKKMESDLTQLQSEVEEAVQEC RNAEEKAKKAITDAAMMAEELKKEQDTSAHLERMKKNMEQTIKDLQHRLDEAEQIAL KGGKKQLQKLEARVRELEGELEAEQKRNAESVKGMRKSERRIKELTYQTEEDKKNLLR LQDLVDKLQLKVKAYKRQAEEAEEQANT NLSKFRKVQHELDEAEERADIAESQVNKL RAKSRDIGAKQKMHDEE corresponding to amino acids 528-1939 of MYH6_HUMAN_V3 (SEQ ID NO:340), which also corresponds to amino acids 23-1434 of HSACMHCP_PEA__1_P12 (SEQ ID NO:330), wherein said first amino acid sequence and second amino acid sequence are contiguous and in a sequential order.

2. An isolated polypeptide encoding for a head of HSACMHCP_PEA__1_P12 (SEQ ID NO:330), comprising a polypeptide being at least 70%, optionally at least about 80%, preferably at least about 85%, more preferably at least about 90% and most preferably at least about 95% homologous to the sequence MGLWKPGSVLSDSLFASSPCPQ (SEQ ID NO:395) of HSACMHCP_PEA__1_P2 (SEQ ID NO:330).

It should be noted that the known protein sequence (MYH6_HUMAN (SEQ ID NO:391)) has one or more changes than the sequence given at the end of the application and named as being the amino acid sequence for MYH6_HUMAN_V3 (SEQ ID NO:340). These changes were previously known to occur and are listed in the table below.

TABLE 16

| Changes to MYH6_HUMAN_V3 (SEQ ID NO: 340) | |
|---|---|
| SNP position(s) on amino acid sequence | Type of change |
| 1735 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HSACMHCP_PEA__1_P12 (SEQ ID NO:330) also has the following non-silent SNPs (Single Nucleotide Polymorphisms) as listed in Table 17, (given according to their position(s) on the amino acid sequence, with the alternative amino acid(s) listed; the last column indicates whether the SNP is known or not; the presence of known SNPs in variant protein HSACMHCP_PEA__1_P12 (SEQ ID NO:330) sequence provides support for the deduced sequence of this variant protein according to the present invention).

TABLE 17

| Amino acid mutations | | |
|---|---|---|
| SNP position(s) on amino acid sequence | Alternative amino acid(s) | Previously known SNP? |
| 10 | L -> F | Yes |
| 35 | M -> R | No |
| 278 | L -> M | Yes |
| 596 | A -> V | Yes |
| 625 | A -> T | No |
| 825 | A -> | No |
| 1232 | T -> S | Yes |

Variant protein HSACMHCP_PEA__1_P12 (SEQ ID NO:330) is encoded by the following transcript(s): HSAC- MHCP_PEA_1_T13 (SEQ ID NO:57), for which the sequence(s) is/are given at the end of the application. The coding portion of transcript HSACMHCP_PEA_1_T13 (SEQ ID NO:57) is shown in bold; this coding portion starts at position 67 and ends at position 4368. The transcript also has the following SNPs as listed in Table 18 (given according to their position on the nucleotide sequence, with the alternative nucleic acid listed; the last column indicates whether the SNP is known or not; the presence of known SNPs in variant protein HSACMHCP_PEA_1_P12 (SEQ ID NO:330) sequence provides support for the deduced sequence of this variant protein according to the present invention).

TABLE 18

Nucleic acid SNPs

| SNP position on nucleotide sequence | Alternative nucleic acid | Previously known SNP? |
|---|---|---|
| 94 | C -> T | Yes |
| 170 | T -> G | No |
| 898 | C -> A | Yes |
| 1384 | C -> T | Yes |
| 1853 | C -> T | Yes |
| 1939 | G -> A | No |
| 2540 | C -> | No |
| 2562 | G -> A | Yes |
| 2865 | T -> C | Yes |
| 2868 | T -> C | Yes |
| 3465 | C -> T | No |
| 3531 | C -> T | Yes |
| 3753 | G -> T | Yes |
| 3756 | T -> C | Yes |
| 3760 | A -> T | Yes |
| 3810 | C -> T | Yes |

Variant protein HSACMHCP_PEA_1_P16 (SEQ ID NO:331) according to the present invention has an amino acid sequence as given at the end of the application; it is encoded by transcript(s) HSACMHCP_PEA_1_T17 (SEQ ID NO:59). An alignment is given to the known protein (Myosin heavy chain, cardiac muscle alpha isoform (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSACMHCP_PEA_1_P16 (SEQ ID NO:331) and MYH6_HUMAN_V2 (SEQ ID NO:339):

1. An isolated chimeric polypeptide encoding for HSAC-MHCP_PEA_1_P16 (SEQ ID NO:331), comprising a first amino acid sequence being at least 90% homologous to MTDAQMADFGAAAQYLRKSEKER-LEAQTRPFDIRTECFVPDDKEEFVKAKILSREGGK VIAETENGKTVTVKEDQVLQQNPPKFDK-IEDMAMLTFLHEPAVLFNLKERYAAWMIYT YSGLFCVTVNPYKWLPVYNAEV-VAAYRGKKRSEAPPHIFSISDNAYQYMLTDRENQSI LITGESGAGKTVNTKRVIQYFA-SIAAIGDRGKKDNANANKGTLEDQIIQANPALEAFGN AKTVRNDNSSRFGKFIRIHFGATGKLA-SADIETYLLEKSRVIFQLKAERNYHIFYQILSNK KPELLDMLLVTNNPYDYAFVSQGEVS-VASIDDSEELMATDSAFDVLGFTSEEKAGVYK LTGAIMHYGNMKFKQKQREEQAEP-DGTEDADKSAYLMGLNSADLLKGLCHPRVKVG NEYVTKGQSVQQVYYSIGALAKAVYEKM- FNWMVTRINATLETKQPRQYFIGVLDIAGF EIFDFNS-FEQLCINFTNEKLQQFFNHHMFV-LEQEEYKKEGIEWTFIDFGMDLQACIDLIEK corresponding to amino acids 1-527 of MYH6_HUMAN_V2 (SEQ ID NO:339), which also corresponds to amino acids 1-527 of HSACMHCP_PEA_1_P16 (SEQ ID NO:331), and a second amino acid sequence being at least 70%, optionally at least 80%, preferably at least 85%, more preferably at least 90% and most preferably at least 95% homologous to a polypeptide having the sequence VPPWPHHLCPLLCHPDKVVAESLLHPRN (SEQ ID NO:435) corresponding to amino acids 528-555 of HSAC-MHCP_PEA_1_P16 (SEQ ID NO:331), wherein said first amino acid sequence and second amino acid sequence are contiguous and in a sequential order.

2. An isolated polypeptide encoding for a tail of HSAC-MHCP_PEA_1_P16 (SEQ ID NO:331), comprising a polypeptide being at least 70%, optionally at least about 80%, preferably at least about 85%, more preferably at least about 90% and most preferably at least about 95% homologous to the sequence VPPWPHHLCPLLCHPDKV-VAESLLHPRN (SEQ ID NO:435) in HSACMHCP_PEA_1_P16 (SEQ ID NO:331).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HSACMHCP_PEA_1_P16 (SEQ ID NO:331) also has the following non-silent SNPs (Single Nucleotide Polymorphisms) as listed in Table 20, (given according to their position(s) on the amino acid sequence, with the alternative amino acid(s) listed; the last column indicates whether the SNP is known or not; the presence of known SNPs in variant protein HSACMHCP_PEA_1_P16 (SEQ ID NO:331) sequence provides support for the deduced sequence of this variant protein according to the present invention).

TABLE 20

Amino acid mutations

| SNP position(s) on amino acid sequence | Alternative amino acid(s) | Previously known SNP? |
|---|---|---|
| 88 | E -> Q | Yes |
| 376 | P -> Q | Yes |

Variant protein HSACMHCP_PEA_1_P16 (SEQ ID NO:331) is encoded by the following transcript(s): HSAC-MHCP_PEA_1_T17 (SEQ ID NO:59), for which the sequence(s) is/are given at the end of the application. The coding portion of transcript HSACMHCP_PEA_1_T17 (SEQ ID NO:59) is shown in bold; this coding portion starts at position 78 and ends at position 1742. The transcript also has the following SNPs as listed in Table 21 (given according to their position on the nucleotide sequence, with the alternative nucleic acid listed; the last column indicates whether the SNP is known or not; the presence of known SNPs in variant protein HSACMHCP_PEA_1_P16 (SEQ ID NO:331) sequence provides support for the deduced sequence of this variant protein according to the present invention).

TABLE 21

| Nucleic acid SNPs | | |
|---|---|---|
| SNP position on nucleotide sequence | Alternative nucleic acid | Previously known SNP? |
| 339 | G -> C | Yes |
| 488 | A -> G | Yes |
| 504 | A -> C | Yes |
| 887 | G -> A | Yes |
| 1204 | C -> A | Yes |
| 1205 | A -> C | Yes |
| 1232 | G -> T | No |
| 2094 | C -> T | Yes |
| 2095 | G -> A | Yes |
| 2347 | A -> G | Yes |

Variant protein HSACMHCP_PEA_1_P25 (SEQ ID NO:332) according to the present invention has an amino acid sequence as given at the end of the application; it is encoded by transcript(s) HSACMHCP_PEA_1_T26 (SEQ ID NO:60). An alignment is given to the known protein (Myosin heavy chain, cardiac muscle alpha isoform (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSACMHCP_PEA_1_P25 (SEQ ID NO:332) and MYH6_HUMAN_V I (SEQ ID NO:338):

1. An isolated chimeric polypeptide encoding for HSACMHCP_PEA_1_P25 (SEQ ID NO:332), comprising a first amino acid sequence being at least 90% homologous to MTDAQMADFGAAAQYLRKSEKER-LEAQTRPFDIRTECFVPDDKEEFVKAKILSREGGK VIAETENGKTVTVKEDQVLQQNPPKFDK-IEDMAMLTFLHEPAVLFNLKERYAAWMIYT YSGLFCVTVNPYKWLPVYNAEV-VAAYRGKKRSEAPPHIFSISDNAYQYMLTDRENQSI LITGESGAGKTVNTKRVIQYFA-SIAAIGDRGKKDNANANKGTLEDQIIQANPALEAFGN AKTVRNDNSSRFGKFIRIHFGATGKLA-SADIETYLLEKSRVIFQLKAERNYHIFYQILSNK KPELLDMLLVTNNPYDYAFVSQGEVS-VASIDDSEELMATDSAFDVLGFTSEEKAGVYK LTGAIMHYGNMKFKQKQREEQAEP-DGTEDADKSAYLMGLNSADLLKGLCHPRVKVG NEYVTKGQSVQQVYYSIGALAKAVYEKM-FNWMVTRINATLETKQPRQYFIGVLDIAGF EIFD corresponding to amino acids 1-470 of MYH6_HUMAN_V1 (SEQ ID NO:338), which also corresponds to amino acids 1-470 of HSACMHCP_PEA_1_P25 (SEQ ID NO:332), a second amino acid sequence being at least 90% homologous to PMGIMSILEEECMFPKATDMTFKAKLYD-NHLGKSNNFQKPRNIKGKQEAHFSLIHYAGT VDY-NILGWLEKNKDPLNETVVALYQKSSLKL-MATLFSSYATADTGDSGKSKGGKKKG SSFQTVSALHRENLNKLMTNLRTTHPH-FVRCIIPNERKAPGVMDNPLVMHQLRCNGVL EGIRI-CRKGFPNRILYGDFRQRYRILN-PVAIPEGQFIDSRKGTEKLLSSLDIDHNQYKFGH TKVFFKAGLLGLLEEMRDERLSRIITRM-QAQARGQLMRIEFKKIVERRDALLVIQWNIR AFMGVKNWPWMKLYFKIKPLLKSA-ETEKEMATMKEEFGRIKETLEKSEARRKELEEK MVSLLQEKNDLQLQVQAEQDNLNDAEER-CDQLIKNKIQLEAKVKEMNERLEDEEEMN AELTAKKRKLEDECSELKKDIDDLELT-LAKVEKEKHATENKVKNLTEEMAGLDEIIAKL TKEKKALQEAHQQALDDLQVEEDKVNSL-SKSKVKLEQQVDDLEGSLEQEKKVRMDLE RAKRRKLEGDLKLTQESIMDLEND-KLQLEEKLKKKEFDINQQNSKIEDEQALALQLQKK LKENQARIEELEEELEAERTARAKVEKL-RSDLSRELEEISERLEEAGGATSVQIEMNKKR EAEFQKMRRDLEEATLQHEATAAAL-RKKHADSVAELGEQIDNLQRVKQKLEKEKSEF KLELDDVTSNMEQIIKAKANLEKVSR-TLEDQANEYRVKLEEAQRSLNDFTTQRAKLQT ENGELARQLEEKEALISQLTRGKL-SYTQQMEDLKRQLEEEGKAKNALAHALQSARHDC DLLREQYEEETEAKAELQRVLS-KANSEVAQWRTKYETDAIQRTEELEEAKKKLAQRLQ DAEEEAVEAVNAKCSSLEKTKHRLQ-NEIEDLMVDVERSNAAAAALDKKQRNFDKILAE WKQKYEESQSELESSQKEARSL-STELFKLKNAYEESLEHLETFKRENKNLQEEISDLTEQ LGEGGKNVHELEKVRKQLEVEKLELQSA-LEEAEASLEHEEGKILRAQLEFNQIKAEIER KLAEKDEEMEQAKRNHQRVVD-SLQTSLDAETRSRNEVLRVKKKMEGDLNEMEIQLSH ANRMAAEAQKQVKSLQSLLKDTQIQLD-DAVRANDDLKENIAIVERRNNLLQAELEELR AVVEQTERSRKLAEQELIETSERVQLLH-SQNTSLINQKKKMESDLTQLQSEVEEAVQEC RNAEEKAKKAITDAAMMAEELKKEQDT-SAHLERMKKNMEQTIKDLQHRLDEAEQIAL KGGKKQLQKLEARVRELEGELEAEQKRN-AESVKGMRKSERRIKELTYQ corresponding to amino acids 528-1855 of MYH6_HUMAN_V1 (SEQ ID NO:338), which also corresponds to amino acids 471-1798 of HSACMHCP_PEA_1_P25 (SEQ ID NO:332), and a third amino acid sequence being at least 70%, optionally at least 80%, preferably at least 85%, more preferably at least 90% and most preferably at least 95% homologous to a polypeptide having the sequence VRRTPDTGSRCGSFFS-GPTAPPSQGSSHLLLEMLLVDLTFFSRSAVSLT (SEQ ID NO:394) corresponding to amino acids 1799-1847 of HSACMHCP_PEA_1_P25 (SEQ ID NO:332), wherein said first amino acid sequence, second amino acid sequence and third amino acid sequence are contiguous and in a sequential order.

2. An isolated chimeric polypeptide encoding for an edge portion of HSACMHCP_PEA_1_P25 (SEQ ID NO:332), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DP, having a structure as follows: a sequence starting from any of amino acid numbers 470−x to 470; and ending at any of amino acid numbers 471+((n−2)−x), in which x varies from 0 to n−2.

3. An isolated polypeptide encoding for a tail of HSACMHCP_PEA_1_P25 (SEQ ID NO:332), comprising a polypeptide being at least 70%, optionally at least about 80%, preferably at least about 85%, more preferably at least about 90% and most preferably at least about 95% homologous to the sequence VRRTPDTGSRCGSFFS-GPTAPPSQGSSHLLLEMLLVDLTFFSRSAVSLT (SEQ ID NO:394) in HSACMHCP_PEA_1_P25 (SEQ ID NO:332).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HSACMHCP_PEA_1_P25 (SEQ ID NO:332) also has the following non-silent SNPs (Single Nucleotide Polymorphisms) as listed in Table 23, (given according to their position(s) on the amino acid sequence, with the alternative amino acid(s) listed; the last column indicates whether the SNP is known or not; the presence of known SNPs in variant protein HSACMHCP_PEA_1_P25 (SEQ ID NO:332) sequence provides support for the deduced sequence of this variant protein according to the present invention).

TABLE 23

Amino acid mutations

| SNP position(s) on amino acid sequence | Alternative amino acid(s) | Previously known SNP? |
|---|---|---|
| 88 | E -> Q | Yes |
| 376 | P -> Q | Yes |
| 483 | M -> R | No |
| 726 | L -> M | Yes |
| 1044 | A -> V | Yes |
| 1073 | A -> T | No |
| 1273 | A -> | No |
| 1680 | T -> S | Yes |
| 1806 | G -> R | Yes |

Variant protein HSACMHCP_PEA_1_P25 (SEQ ID NO:332) is encoded by the following transcript(s): HSACMHCP_PEA_1_T26 (SEQ ID NO:60), for which the sequence(s) is/are given at the end of the application. The coding portion of transcript HSACMHCP_PEA_1_T26 (SEQ ID NO:60) is shown in bold; this coding portion starts at position 78 and ends at position 5618. The transcript also has the following SNPs as listed in Table 24 (given according to their position on the nucleotide sequence, with the alternative nucleic acid listed; the last column indicates whether the SNP is known or not; the presence of known SNPs in variant protein HSACMHCP_PEA_1_P25 (SEQ ID NO:332) sequence provides support for the deduced sequence of this variant protein according to the present invention).

TABLE 24

Nucleic acid SNPs

| SNP position on nucleotide sequence | Alternative nucleic acid | Previously known SNP? |
|---|---|---|
| 339 | G -> C | Yes |
| 488 | A -> G | Yes |
| 504 | A -> C | Yes |
| 887 | G -> A | Yes |
| 1204 | C -> A | Yes |
| 1205 | A -> C | Yes |

TABLE 24-continued

Nucleic acid SNPs

| SNP position on nucleotide sequence | Alternative nucleic acid | Previously known SNP? |
|---|---|---|
| 1232 | G -> T | No |
| 1525 | T -> G | No |
| 2253 | C -> A | Yes |
| 2739 | C -> T | Yes |
| 3208 | C -> T | Yes |
| 3294 | G -> A | No |
| 3895 | C -> | No |
| 3917 | G -> A | Yes |
| 4220 | T -> C | Yes |
| 4223 | T -> C | Yes |
| 4820 | C -> T | No |
| 4886 | C -> T | Yes |
| 5108 | G -> T | Yes |
| 5111 | T -> C | Yes |
| 5115 | A -> T | Yes |
| 5165 | C -> T | Yes |
| 5493 | G -> A | Yes |
| 5970 | C -> T | Yes |

Variant protein HSACMHCP_PEA_1_P28 (SEQ ID NO:333) according to the present on has an amino acid sequence as given at the end of the application; it is encoded by transcript(s) HSACMHCP_PEA_1_T8 (SEQ ID NO:56). An alignment is given to the known protein (Myosin heavy chain, cardiac muscle alpha isoform (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSACMHCP_PEA_1_P28 (SEQ ID NO:333) and MYH6_HUMAN_V3 (SEQ ID NO:340):

1. An isolated chimeric polypeptide encoding for HSACMHCP_PEA_1_P28 (SEQ ID NO:333), comprising a first amino acid sequence being at least 90% homologous to MLTDRENQSILITGESGAGKTVNT-KRVIQYFASIAAIGDRGKKDNANANKGTLEDQIIQA NPALEAFGNAKTVRNDNSSRFGKFIRIH-FGATGKLASADIETYLLEKSRVIFQLKAERNY HIFY-QILSNKKPELLDMLLVTNNPYDYAFVSQ-GEVSVASIDDSEELMATDSAFDVLGFT SEEKAGVYKLTGAIMHYGNMKFKQKQRE-EQAEPDGTEDADKSAYLMGLNSADLLKG LCH-PRVKVGNEYVTKGQSVQQVYYSI-GALAKAVYEKMFNWMVTRINATLETKQPRQ YFIGVLDIAGFEIFDFNSFEQLCINFT-NEKLQQFFNHHMFVLEQEEYKKEGIEWTFIDFGM DLQACIDLIEKPMGIMSILEEECMFP-KATDMTFKAKLYDNHLGKSNNFQKPRNIKGKQE AHFSLIHYAGTVDYNILGWLEKNKDPL-NETVVALYQKSSLKLMATLFSSYATADTGDS GKSKG-GKKKGSSFQTVSALHRENLNKLMTNLRT-THPHFVRCIIPNERKAPGVMDNPLV MHQLRCNGVLEGIRICRKGFPNRILYGD-FRQRYRILNPVAIPEGQFIDSRKGTEKLLSSLD IDH-NQYKFGHTKVFFKAGLLGLLEEM-RDERLSRIITRMQAQARGQLMRIEFKKIVERRD ALLVIQWNIRAFMGVKNWPWMKLYFKIK-PLLKSAETEKEMATMKEEFGRIKETLEKSE ARR-KELEEKMVS-LLQEKNDLQLQVQAEQDNLNDAEERCDQLIKNKIQ LEAKVKEMNE RLEDEEEMNAELTAKKRKLEDECSELKKDIDDLELTLAKVEKEKHATENKVKNLTEEM AGLDEIIAKLTKEKKALQEAHQQALDDLQVEEDKVNSLSKSKVKLEQQVDDLEGSLEQ EKKVRMDLERAKRKLEGDLKLTQESIMDLENDKLQLEEKLKKKEFDINQQNSKIEDEQ ALALQLQKKLKENQARIEELEEELEAERTARAKVEKLRSDLSRELEEISERLEEAGGATS VQIEMNKKREAEFQKMRRDLEEATLQHEATAAALRKKHADSVAELGEQIDNLQRVKQ KLEKEKSEFKLELDDVTSNMEQIIKAKANLEKVSRTLEDQANEYRVKLEEAQRSLNDFT TQRAKLQTENGELARQLEEKEALISQLTRGKLSYTQQMEDLKRQLEEEGKAKNALAHA LQSARHDCDLLREQYEEETEAKAELQRVLSKANSEVAQWRTKYETDAIQRTEELEEAK KKLAQRLQDAEEAVEAVNAKCSSLEKTKHRLQNEIEDLMVDVERSNAAAAALDKKQR NFDKILAEWKQKYEESQSELESSQKEARSLSTELFKLKNAYEESLEHLETFKRENKNLQ EEISDLTEQLGEGGKNVHELEKVRKQLEVEKLELQSALEEAEASLEHEEGKILRAQLEF NQIKAEIERKLAEKDEEMEQAKRNHQRVVDSLQTSLDAETRSRNEVLRVKKKMEGDL NEMEIQLSHANRMAAEAQKQVKSLQSLLKDTQIQLDDAVRANDDLKENIAIVERRNNL LQAELEELRAVVEQTERSRKLAEQELIETSERVQLLHSQNTSLINQKKKMESDLTQLQSE VEEAVQECRNAEEKAKKAITDAAMMAEELKKEQDTSAHLERMKKNMEQTIKDLQHR LDEAEQIALKGGKKQLQKLEARVRELEGELEAEQKRNAESVKGMRKSERRIKELTYQT EEDKKNLLRLQDLVDKLQLKVKAYKRQAEEAEEQANTNLSKFRK VQHELDEAEERAD IAESQVNKLRAKSRDIGAKQKMHDEE corresponding to amino acids 165-1939 of MYH6_HUMAN_V3 (SEQ ID NO:340), which also corresponds to amino acids 1-1775 of HSACMHCP_PEA_1_P28 (SEQ ID NO:333).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HSACMHCP_PEA_1_P28 (SEQ ID NO:333) also has the following non-silent SNPs (Single Nucleotide Polymorphisms) as listed in Table 26, (given according to their position(s) on the amino acid sequence, with the alternative amino acid(s) listed; the last column indicates whether the SNP is known or not; the presence of known SNPs in variant protein HSACMHCP_PEA_1_P28 (SEQ ID NO:333) sequence provides support for the deduced sequence of this variant protein according to the present invention).

TABLE 26

Amino acid mutations

| SNP position(s) on amino acid sequence | Alternative amino acid(s) | Previously known SNP? |
| --- | --- | --- |
| 212 | P -> Q | Yes |
| 376 | M -> R | No |

TABLE 26-continued

Amino acid mutations

| SNP position(s) on amino acid sequence | Alternative amino acid(s) | Previously known SNP? |
| --- | --- | --- |
| 619 | L -> M | Yes |
| 937 | A -> V | Yes |
| 966 | A -> T | No |
| 1166 | A -> | No |
| 1573 | T -> S | Yes |

Variant protein HSACMHCP_PEA_1_P28 (SEQ ID NO:333) is encoded by the following transcript(s): HSACMHCP_PEA_1_T8 (SEQ ID NO:56), for which the sequence(s) is/are given at the end of the application. The coding portion of transcript HSACMHCP_PEA_1_T8 (SEQ ID NO:56) is shown in bold; this coding portion starts at position 12 and ends at position 5336. The transcript also has the following SNPs as listed in Table 27 (given according to their position on the nucleotide sequence, with the alternative nucleic acid listed; the last column indicates whether the SNP is known or not; the presence of known SNPs in variant protein HSACMHCP_PEA_1_P28 (SEQ ID NO:333) sequence provides support for the deduced sequence of this variant protein according to the present invention).

TABLE 27

Nucleic acid SNPs

| SNP position on nucleotide sequence | Alternative nucleic acid | Previously known SNP? |
| --- | --- | --- |
| 329 | G -> A | Yes |
| 646 | C -> A | Yes |
| 647 | A -> C | Yes |
| 674 | G -> T | No |
| 1138 | T -> G | No |
| 1866 | C -> A | Yes |
| 2352 | C -> T | Yes |
| 2821 | C -> T | Yes |
| 2907 | G -> A | No |
| 3508 | C -> | No |
| 3530 | G -> A | Yes |
| 3833 | T -> C | Yes |
| 3836 | T -> C | Yes |
| 4433 | C -> T | No |
| 4499 | C -> T | Yes |
| 4721 | G -> T | Yes |
| 4724 | T -> C | Yes |
| 4728 | A -> T | Yes |
| 4778 | C -> T | Yes |

Variant protein HSACMHCP_PEA_1_P29 (SEQ ID NO:334) according to the present invention has an amino acid sequence as given at the end of the application; it is encoded by transcript(s) HSACMHCP_PEA_1_T14 (SEQ ID NO:58). An alignment is given to the known protein (Myosin heavy chain, cardiac muscle alpha isoform (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSACMHCP_PEA_1_P29 (SEQ ID NO:334) and MYH6_HUMAN_V3 (SEQ ID NO:340):

1. An isolated chimeric polypeptide encoding for HSAC-MHCP_PEA_1_P29 (SEQ ID NO:334), comprising a first amino acid sequence being at least 90% homologous to MNKKKREAEFQKMRRDLEE-ATLQHEATAAALRKKHADSVAELGE-QIDNLQRVKQKLEK EKSEFKLELDDVTSNMEQIIKA-KANLEKVSRTLEDQANEYRVKLEEAQRSLNDFTTQRA KLQTENGELARQLEEKEALISQLTRGKL-SYTQQMEDLKRQLEEEGKAKNALAHALQSA RHD-CDLLREQYEEETEAKAELQRVLS-KANSEVAQWRTKYETDAIQRTEELEEAKKKLA QRLQDAEEAVEAVNAKCSSLEKTKHRLQ-NEIEDLMVDVERSNAAAAALDKKQRNFDK ILAEWKQKYEESQSELESSQKEARSL-STELFKLKNAYEESLEHLETFKRENKNLQEEISD LTE-QLGEGGKNVHELEKVRKQLEVEK-LELQSALEEAEASLEHEEGKILRAQLEFNQIKA EIERKLAEKDEEMEQAKRNHQRVVD-SLQTSLDAETRSRNEVLRVKKKMEGDLNEMEI QLS-HANRMAAEAQKQVKSLQSLLKDTQIQLD-DAVRANDDLKENIAIVERRNNLLQAEL EELRAVVEQTERSRKLAEQELIET-SERVQLLHSQNTSLINQKKKMESDLTQLQSEVEEA VQECRNAEEKAKKAITDAAM-MAEELKKEQDTSAHLERMKKNMEQ-TIKDLQHRLDEA EQIALKG-GKKQLQKLEARVRELEGELEAEQKRNAESVKGMRK SERRIKELTYQTEEDK KNLLRLQDLVD-KLQLKVKAYKRQAEEAEEQANTNL-SKFRKVQHELDEAEERADIAES QVNKLRAKSRDI-GAKQKMHDEE corresponding to amino acids 1165-1939 of MYH6_HUMAN_V3 (SEQ ID NO:340), which also corresponds to amino acids 1-775 of HSACMHCP_PEA_1_P29 (SEQ ID NO:334).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein HSACMHCP_PEA_1_P29 (SEQ ID NO:334) also has the following non-silent SNPs (Single Nucleotide Polymorphisms) as listed in Table 29, (given according to their position(s) on the amino acid sequence, with the alternative amino acid(s) listed; the last column indicates whether the SNP is known or not; the presence of known SNPs in variant protein HSACMHCP_PEA_1_P29 (SEQ ID NO:334) sequence provides support for the deduced sequence of this variant protein according to the present invention).

TABLE 29

Amino acid mutations

| SNP position(s) on amino acid sequence | Alternative amino acid(s) | Previously known SNP? |
|---|---|---|
| 166 | A -> | No |
| 573 | T -> S | Yes |

Variant protein HSACMHCP_PEA_1_P29 (SEQ ID NO:334) is encoded by the following transcript(s): HSAC-MHCP_PEA_1_T14 (SEQ ID NO:58), for which the sequence(s) is/are given at the end of the application. The coding portion of transcript HSACMHCP_PEA_1_T14 (SEQ ID NO:58) is shown in bold; this coding portion starts at position 150 and ends at position 2474. The transcript also has the following SNPs as listed in Table 30 (given according to their position on the nucleotide sequence, with the alternative nucleic acid listed; the last column indicates whether the SNP is known or not; the presence of known SNPs in variant protein HSACMHCP_PEA_1_P29 (SEQ ID NO:334) sequence provides support for the deduced sequence of this variant protein according to the present invention).

TABLE 30

Nucleic acid SNPs

| SNP position on nucleotide sequence | Alternative nucleic acid | Previously known SNP? |
|---|---|---|
| 34 | G -> T | Yes |
| 51 | -> G | No |
| 646 | C -> | No |
| 668 | G -> A | Yes |
| 971 | T -> C | Yes |
| 974 | T -> C | Yes |
| 1571 | C -> T | No |
| 1637 | C -> T | Yes |
| 1859 | G -> T | Yes |
| 1862 | T -> C | Yes |
| 1866 | A -> T | Yes |
| 1916 | C -> T | Yes |

As noted above, cluster HSACMHCP features 65 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSACMHCP_PEA_1_node_2 (SEQ ID NO:209) according to the present invention is supported by 10 libraries. The number of libraries was determined as previously described. This segment can be found in the following transcript(s): HSACMHCP_PEA_1_T14 (SEQ ID NO:58). Table 31 below describes the starting and ending position of this segment on each transcript.

TABLE 31

Segment location on transcripts

| Transcript name | Segment starting position | Segment ending position |
|---|---|---|
| HSACMHCP_PEA_1_T14 (SEQ ID NO: 58) | 1 | 328 |

Segment cluster HSACMHCP_PEA_1_node_20 (SEQ ID NO:210) according to the present invention is supported by 6 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_PEA_1_T6 (SEQ ID NO:54), HSACMHCP_PEA_1_T7 (SEQ ID NO:55), HSACMHCP_PEA_1_T17 (SEQ ID NO:59) and HSACMHCP_PEA_1_T26 (SEQ ID NO:60). Table 32 below describes the starting and ending position of this segment on each transcript.

TABLE 32

Segment location on transcripts

| Transcript name | Segment starting position | Segment ending position |
|---|---|---|
| HSACMHCP_PEA_1_T2 (SEQ ID NO: 51) | 65 | 278 |
| HSACMHCP_PEA_1_T3 (SEQ ID NO: 52) | 65 | 278 |
| HSACMHCP_PEA_1_T4 (SEQ ID NO: 53) | 65 | 278 |
| HSACMHCP_PEA_1_T6 (SEQ ID NO: 54) | 65 | 278 |
| HSACMHCP_PEA_1_T7 (SEQ ID NO: 55) | 65 | 278 |
| HSACMHCP_PEA_1_T17 (SEQ ID NO: 59) | 65 | 278 |
| HSACMHCP_PEA_1_T26 (SEQ ID NO: 60) | 65 | 278 |

Segment cluster HSACMHCP_PEA_1_node_22 (SEQ ID NO:211) according to the present invention is supported by 7 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T17 (SEQ ID NO:59) and HSACMHCP_PEA_1_T26 (SEQ ID NO:60). Table 33 below describes the starting and ending position of this segment on each transcript.

TABLE 33

Segment location on transcripts

| Transcript name | Segment starting position | Segment ending position |
|---|---|---|
| HSACMHCP_PEA_1_T2 (SEQ ID NO: 51) | 279 | 400 |
| HSACMHCP_PEA_1_T3 (SEQ ID NO: 52) | 279 | 400 |
| HSACMHCP_PEA_1_T4 (SEQ ID NO: 53) | 279 | 400 |
| HSACMHCP_PEA_1_T6 (SEQ ID NO: 54) | 279 | 400 |
| HSACMHCP_PEA_1_T7 (SEQ ID NO: 55) | 279 | 400 |
| HSACMHCP_PEA_1_T17 (SEQ ID NO: 59) | 279 | 400 |
| HSACMHCP_PEA_1_T26 (SEQ ID NO: 60) | 279 | 400 |

Segment cluster HSACMHCP_PEA_1_node_25 (SEQ ID NO:212) according to the present invention is supported by 6 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T17 (SEQ ID NO:59) and HSACMHCP_PEA_1_T26 (SEQ ID NO:60). Table 34 below describes the starting and ending position of this segment on each transcript.

TABLE 34

Segment location on transcripts

| Transcript name | Segment starting position | Segment ending position |
|---|---|---|
| HSACMHCP_PEA_1_T2 (SEQ ID NO: 51) | 423 | 579 |
| HSACMHCP_PEA_1_T3 (SEQ ID NO: 52) | 423 | 579 |
| HSACMHCP_PEA_1_T4 (SEQ ID NO: 53) | 423 | 579 |
| HSACMHCP_PEA_1_T6 (SEQ ID NO: 54) | 423 | 579 |
| HSACMHCP_PEA_1_T7 (SEQ ID NO: 55) | 423 | 579 |
| HSACMHCP_PEA_1_T17 (SEQ ID NO: 59) | 423 | 579 |
| HSACMHCP_PEA_1_T26 (SEQ ID NO: 60) | 423 | 579 |

Segment cluster HSACMHCP_PEA_1_node_43 (SEQ ID NO:213) according to the present invention is supported by 8 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T17 (SEQ ID NO:59) and HSACMHCP_PEA_1_T26 (SEQ ID NO:60). Table 35 below describes the starting and ending position of this segment on each transcript.

TABLE 35

Segment location on transcripts

| Transcript name | Segment starting position | Segment ending position |
|---|---|---|
| HSACMHCP_PEA_1_T2 (SEQ ID NO: 51) | 1219 | 1487 |
| HSACMHCP_PEA_1_T3 (SEQ ID NO: 52) | 1219 | 1487 |
| HSACMHCP_PEA_1_T4 (SEQ ID NO: 53) | 1219 | 1487 |
| HSACMHCP_PEA_1_T6 (SEQ ID NO: 54) | 1219 | 1487 |
| HSACMHCP_PEA_1_T7 (SEQ ID NO: 55) | 1219 | 1487 |
| HSACMHCP_PEA_1_T8 (SEQ ID NO: 56) | 661 | 929 |
| HSACMHCP_PEA_1_T17 (SEQ ID NO: 59) | 1219 | 1487 |
| HSACMHCP_PEA_1_T26 (SEQ ID NO: 60) | 1219 | 1487 |

Segment cluster HSACMHCP_PEA_1_node_45 (SEQ ID NO:214) according to the present invention is supported by 8 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_ PEA_1_T6 (SEQ ID NO:54), HSACMHCP_PEA_1_T7 (SEQ ID NO:55), HSACMHCP_PEA_1_T8 (SEQ ID NO:56) and HSACMHCP_PEA_1_T17 (SEQ ID NO:59). Table 36 below describes the starting and ending position of this segment on each transcript.

TABLE 36

Segment location on transcripts

| Transcript name | Segment starting position | Segment ending position |
|---|---|---|
| HSACMHCP_PEA_1_T2 (SEQ ID NO: 51) | 1488 | 1658 |
| HSACMHCP_PEA_1_T3 (SEQ ID NO: 52) | 1488 | 1658 |
| HSACMHCP_PEA_1_T4 (SEQ ID NO: 53) | 1488 | 1658 |
| HSACMHCP_PEA_1_T6 (SEQ ID NO: 54) | 1488 | 1658 |
| HSACMHCP_PEA_1_T7 (SEQ ID NO: 55) | 1488 | 1658 |
| HSACMHCP_PEA_1_T8 (SEQ ID NO: 56) | 930 | 1100 |
| HSACMHCP_PEA_1_T17 (SEQ ID NO: 59) | 1488 | 1658 |

Segment cluster HSACMHCP_PEA_1_node_46 (SEQ ID NO:215) according to the present invention is supported by 4 libraries. The number of libraries was determined as previously described. This segment can be found in the following transcript(s): HSACMHCP_PEA_1_T17 (SEQ ID NO:59). Table 37 below describes the starting and ending position of this segment on each transcript.

TABLE 37

Segment location on transcripts

| Transcript name | Segment starting position | Segment ending position |
|---|---|---|
| HSACMHCP_PEA_1_T17 (SEQ ID NO: 59) | 1659 | 2477 |

Segment cluster HSACMHCP_PEA_1_node_48. (SEQ ID NO:216) according to the present invention is supported by 1 libraries. The number of libraries was determined as previously described. This segment can be found in the following transcript(s): HSACMHCP_PEA_1_T13 (SEQ ID NO:57). Table 38 below describes the starting and ending position of this segment on each transcript.

TABLE 38

Segment location on transcripts

| Transcript name | Segment starting position | Segment ending position |
|---|---|---|
| HSACMHCP_PEA_1_T13 (SEQ ID NO: 57) | 1 | 132 |

Segment cluster HSACMHCP_PEA_1_node_49 (SEQ ID NO:217) according to the present invention is supported by 9 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_ 1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 39 below describes the starting and ending position of this segment on each transcript.

TABLE 39

Segment location on transcripts

| Transcript name | Segment starting position | Segment ending position |
|---|---|---|
| HSACMHCP_PEA_1_T2 (SEQ ID NO: 51) | 1659 | 1968 |
| HSACMHCP_PEA_1_T3 (SEQ ID NO: 52) | 1659 | 1968 |
| HSACMHCP_PEA_1_T4 (SEQ ID NO: 53) | 1659 | 1968 |
| HSACMHCP_PEA_1_T6 (SEQ ID NO: 54) | 1659 | 1968 |
| HSACMHCP_PEA_1_T7 (SEQ ID NO: 55) | 1659 | 1968 |
| HSACMHCP_PEA_1_T8 (SEQ ID NO: 56) | 1101 | 1410 |
| HSACMHCP_PEA_1_T13 (SEQ ID NO: 57) | 133 | 442 |
| HSACMHCP_PEA_1_T26 (SEQ ID NO: 60) | 1488 | 1797 |

Segment cluster HSACMHCP_PEA_1_node_57 (SEQ ID NO:218) according to the present invention is supported by 4 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_ PEA_1_T6 (SEQ ID NO:54), HSACMHCP_PEA_ 1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 40 below describes the starting and ending position of this segment on each transcript.

TABLE 40

Segment location on transcripts

| Transcript name | Segment starting position | Segment ending position |
|---|---|---|
| HSACMHCP_PEA_1_T2 (SEQ ID NO: 51) | 2246 | 2369 |
| HSACMHCP_PEA_1_T3 (SEQ ID NO: 52) | 2246 | 2369 |
| HSACMHCP_PEA_1_T4 (SEQ ID NO: 53) | 2246 | 2369 |
| HSACMHCP_PEA_1_T6 (SEQ ID NO: 54) | 2246 | 2369 |
| HSACMHCP_PEA_1_T7 (SEQ ID NO: 55) | 2246 | 2369 |
| HSACMHCP_PEA_1_T8 (SEQ ID NO: 56) | 1688 | 1811 |
| HSACMHCP_PEA_1_T13 (SEQ ID NO: 57) | 720 | 843 |
| HSACMHCP_PEA_1_T26 (SEQ ID NO: 60) | 2075 | 2198 |

Segment cluster HSACMHCP_PEA_1_node_59 (SEQ ID NO:219) according to the present invention is supported by 4 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_ PEA_1_T6 (SEQ ID NO:54), HSACMHCP_PEA_ 1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 41 below describes the starting and ending position of this segment on each transcript.

TABLE 41

Segment location on transcripts

| Transcript name | Segment starting position | Segment ending position |
|---|---|---|
| HSACMHCP_PEA_1_T2 (SEQ ID NO: 51) | 2370 | 2506 |
| HSACMHCP_PEA_1_T3 (SEQ ID NO: 52) | 2370 | 2506 |
| HSACMHCP_PEA_1_T4 (SEQ ID NO: 53) | 2370 | 2506 |
| HSACMHCP_PEA_1_T6 (SEQ ID NO: 54) | 2370 | 2506 |
| HSACMHCP_PEA_1_T7 (SEQ ID NO: 55) | 2370 | 2506 |
| HSACMHCP_PEA_1_T8 (SEQ ID NO: 56) | 1812 | 1948 |
| HSACMHCP_PEA_1_T13 (SEQ ID NO: 57) | 844 | 980 |
| HSACMHCP_PEA_1_T26 (SEQ ID NO: 60) | 2199 | 2335 |

Segment cluster HSACMHCP_PEA_1_node_61 (SEQ ID NO:220) according to the present invention is supported by 5 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 42 below describes the starting and ending position of this segment on each transcript.

TABLE 42

Segment location on transcripts

| Transcript name | Segment starting position | Segment ending position |
|---|---|---|
| HSACMHCP_PEA_1_T2 (SEQ ID NO: 51) | 2507 | 2762 |
| HSACMHCP_PEA_1_T3 (SEQ ID NO: 52) | 2507 | 2762 |
| HSACMHCP_PEA_1_T4 (SEQ ID NO: 53) | 2507 | 2762 |
| HSACMHCP_PEA_1_T6 (SEQ ID NO: 54) | 2507 | 2762 |
| HSACMHCP_PEA_1_T7 (SEQ ID NO: 55) | 2507 | 2762 |
| HSACMHCP_PEA_1_T8 (SEQ ID NO: 56) | 1949 | 2204 |
| HSACMHCP_PEA_1_T13 (SEQ ID NO: 57) | 981 | 1236 |
| HSACMHCP_PEA_1_T26 (SEQ ID NO: 60) | 2336 | 2591 |

Segment cluster HSACMHCP_PEA_1_node_63 (SEQ ID NO:221) according to the present invention is supported by 6 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 43 below describes the starting and ending position of this segment on each transcript.

TABLE 43

Segment location on transcripts

| Transcript name | Segment starting position | Segment ending position |
|---|---|---|
| HSACMHCP_PEA_1_T2 (SEQ ID NO: 51) | 2763 | 3005 |
| HSACMHCP_PEA_1_T3 (SEQ ID NO: 52) | 2763 | 3005 |
| HSACMHCP_PEA_1_T4 (SEQ ID NO: 53) | 2763 | 3005 |
| HSACMHCP_PEA_1_T6 (SEQ ID NO: 54) | 2763 | 3005 |
| HSACMHCP_PEA_1_T7 (SEQ ID NO: 55) | 2763 | 3005 |
| HSACMHCP_PEA_1_T8 (SEQ ID NO: 56) | 2205 | 2447 |
| HSACMHCP_PEA_1_T13 (SEQ ID NO: 57) | 1237 | 1479 |
| HSACMHCP_PEA_1_T26 (SEQ ID NO: 60) | 2592 | 2834 |

Segment cluster HSACMHCP_PEA_1_node_65 (SEQ ID NO:222) according to the present invention is supported by 7 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 44 below describes the starting and ending position of this segment on each transcript.

TABLE 44

Segment location on transcripts

| Transcript name | Segment starting position | Segment ending position |
|---|---|---|
| HSACMHCP_PEA_1_T2 (SEQ ID NO: 51) | 3006 | 3182 |
| HSACMHCP_PEA_1_T3 (SEQ ID NO: 52) | 3006 | 3182 |
| HSACMHCP_PEA_1_T4 (SEQ ID NO: 53) | 3006 | 3182 |
| HSACMHCP_PEA_1_T6 (SEQ ID NO: 54) | 3006 | 3182 |
| HSACMHCP_PEA_1_T7 (SEQ ID NO: 55) | 3006 | 3182 |
| HSACMHCP_PEA_1_T8 (SEQ ID NO: 56) | 2448 | 2624 |
| HSACMHCP_PEA_1_T13 (SEQ ID NO: 57) | 1480 | 1656 |
| HSACMHCP_PEA_1_T26 (SEQ ID NO: 60) | 2835 | 3011 |

Segment cluster HSACMHCP_PEA_1_node_67 (SEQ ID NO:223) according to the present invention is supported by 8 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7

(SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 45 below describes the starting and ending position of this segment on each transcript.

TABLE 45

Segment location on transcripts

| Transcript name | Segment starting position | Segment ending position |
|---|---|---|
| HSACMHCP_PEA_1_T2 (SEQ ID NO: 51) | 3183 | 3328 |
| HSACMHCP_PEA_1_T3 (SEQ ID NO: 52) | 3183 | 3328 |
| HSACMHCP_PEA_1_T4 (SEQ ID NO: 53) | 3183 | 3328 |
| HSACMHCP_PEA_1_T6 (SEQ ID NO: 54) | 3183 | 3328 |
| HSACMHCP_PEA_1_T7 (SEQ ID NO: 55) | 3183 | 3328 |
| HSACMHCP_PEA_1_T8 (SEQ ID NO: 56) | 2625 | 2770 |
| HSACMHCP_PEA_1_T13 (SEQ ID NO: 57) | 1657 | 1802 |
| HSACMHCP_PEA_1_T26 (SEQ ID NO: 60) | 3012 | 3157 |

Segment cluster HSACMHCP_PEA_1_node_71 (SEQ ID NO:224) according to the present invention is supported by 10 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 46 below describes the starting and ending position of this segment on each transcript.

TABLE 46

Segment location on transcripts

| Transcript name | Segment starting position | Segment ending position |
|---|---|---|
| HSACMHCP_PEA_1_T2 (SEQ ID NO: 51) | 3420 | 3689 |
| HSACMHCP_PEA_1_T3 (SEQ ID NO: 52) | 3420 | 3689 |
| HSACMHCP_PEA_1_T4 (SEQ ID NO: 53) | 3420 | 3689 |
| HSACMHCP_PEA_1_T6 (SEQ ID NO: 54) | 3420 | 3689 |
| HSACMHCP_PEA_1_T7 (SEQ ID NO: 55) | 3420 | 3689 |
| HSACMHCP_PEA_1_T8 (SEQ ID NO: 56) | 2862 | 3131 |
| HSACMHCP_PEA_1_T13 (SEQ ID NO: 57) | 1894 | 2163 |
| HSACMHCP_PEA_1_T26 (SEQ ID NO: 60) | 3249 | 3518 |

Segment cluster HSACMHCP_PEA_1_node_81 (SEQ ID NO:225) according to the present invention is supported by 3 libraries. The number of libraries was determined as previously described. This segment can be found in the following transcript(s): HSACMHCP_PEA_1_T3 (SEQ ID NO:52). Table 47 below describes the starting and ending position of this segment on each transcript.

TABLE 47

Segment location on transcripts

| Transcript name | Segment starting position | Segment ending position |
|---|---|---|
| HSACMHCP_PEA_1_T3 (SEQ ID NO: 52) | 4056 | 4392 |

Segment cluster HSACMHCP_PEA_1_node_87 (SEQ ID NO:226) according to the present invention is supported by 12 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 48 below describes the starting and ending position of this segment on each transcript.

TABLE 48

Segment location on transcripts

| Transcript name | Segment starting position | Segment ending position |
|---|---|---|
| HSACMHCP_PEA_1_T2 (SEQ ID NO: 51) | 4253 | 4436 |
| HSACMHCP_PEA_1_T3 (SEQ ID NO: 52) | 4590 | 4773 |
| HSACMHCP_PEA_1_T4 (SEQ ID NO: 53) | 4253 | 4436 |
| HSACMHCP_PEA_1_T6 (SEQ ID NO: 54) | 4253 | 4436 |
| HSACMHCP_PEA_1_T7 (SEQ ID NO: 55) | 4253 | 4436 |
| HSACMHCP_PEA_1_T8 (SEQ ID NO: 56) | 3695 | 3878 |
| HSACMHCP_PEA_1_T13 (SEQ ID NO: 57) | 2727 | 2910 |
| HSACMHCP_PEA_1_T14 (SEQ ID NO: 58) | 833 | 1016 |
| HSACMHCP_PEA_1_T26 (SEQ ID NO: 60) | 4082 | 4265 |

Segment cluster HSACMHCP_PEA_1_node_89 (SEQ ID NO:227) according to the present invention is supported by 15 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 49 below describes the starting and ending position of this segment on each transcript.

TABLE 49

Segment location on transcripts

| Transcript name | Segment starting position | Segment ending position |
|---|---|---|
| HSACMHCP_PEA_1_T2 (SEQ ID NO: 51) | 4437 | 4602 |
| HSACMHCP_PEA_1_T3 (SEQ ID NO: 52) | 4774 | 4939 |
| HSACMHCP_PEA_1_T4 (SEQ ID NO: 53) | 4437 | 4602 |
| HSACMHCP_PEA_1_T6 (SEQ ID NO: 54) | 4437 | 4602 |
| HSACMHCP_PEA_1_T7 (SEQ ID NO: 55) | 4437 | 4602 |
| HSACMHCP_PEA_1_T8 (SEQ ID NO: 56) | 3879 | 4044 |
| HSACMHCP_PEA_1_T13 (SEQ ID NO: 57) | 2911 | 3076 |
| HSACMHCP_PEA_1_T14 (SEQ ID NO: 58) | 1017 | 1182 |
| HSACMHCP_PEA_1_T26 (SEQ ID NO: 60) | 4266 | 4431 |

Segment cluster HSACMHCP_PEA_1_node_96 (SEQ ID NO:228) according to the present invention is supported by 16 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 50 below describes the starting and ending position of this segment on each transcript.

TABLE 50

Segment location on transcripts

| Transcript name | Segment starting position | Segment ending position |
|---|---|---|
| HSACMHCP_PEA_1_T2 (SEQ ID NO: 51) | 4743 | 4877 |
| HSACMHCP_PEA_1_T3 (SEQ ID NO: 52) | 5080 | 5214 |
| HSACMHCP_PEA_1_T4 (SEQ ID NO: 53) | 4847 | 4981 |
| HSACMHCP_PEA_1_T6 (SEQ ID NO: 54) | 4743 | 4877 |
| HSACMHCP_PEA_1_T7 (SEQ ID NO: 55) | 4743 | 4877 |
| HSACMHCP_PEA_1_T8 (SEQ ID NO: 56) | 4185 | 4319 |
| HSACMHCP_PEA_1_T13 (SEQ ID NO: 57) | 3217 | 3351 |
| HSACMHCP_PEA_1_T14 (SEQ ID NO: 58) | 1323 | 1457 |
| HSACMHCP_PEA_1_T26 (SEQ ID NO: 60) | 4572 | 4706 |

Segment cluster HSACMHCP_PEA_1_node_97 (SEQ ID NO:229) according to the present invention is supported by 16 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 51 below describes the starting and ending position of this segment on each transcript.

TABLE 51

Segment location on transcripts

| Transcript name | Segment starting position | Segment ending position |
|---|---|---|
| HSACMHCP_PEA_1_T2 (SEQ ID NO: 51) | 4878 | 5006 |
| HSACMHCP_PEA_1_T3 (SEQ ID NO: 52) | 5215 | 5343 |
| HSACMHCP_PEA_1_T4 (SEQ ID NO: 53) | 4982 | 5110 |
| HSACMHCP_PEA_1_T6 (SEQ ID NO: 54) | 4878 | 5006 |
| HSACMHCP_PEA_1_T7 (SEQ ID NO: 55) | 4878 | 5006 |
| HSACMHCP_PEA_1_T8 (SEQ ID NO: 56) | 4320 | 4448 |
| HSACMHCP_PEA_1_T13 (SEQ ID NO: 57) | 3352 | 3480 |
| HSACMHCP_PEA_1_T14 (SEQ ID NO: 58) | 1458 | 1586 |
| HSACMHCP_PEA_1_T26 (SEQ ID NO: 60) | 4707 | 4835 |

Segment cluster HSACMHCP_PEA_1_node_100 (SEQ ID NO:230) according to the present invention is supported by 19 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 52 below describes the starting and ending position of this segment on each transcript.

TABLE 52

Segment location on transcripts

| Transcript name | Segment starting position | Segment ending position |
|---|---|---|
| HSACMHCP_PEA_1_T2 (SEQ ID NO: 51) | 5037 | 5240 |
| HSACMHCP_PEA_1_T3 (SEQ ID NO: 52) | 5374 | 5577 |
| HSACMHCP_PEA_1_T4 (SEQ ID NO: 53) | 5141 | 5344 |
| HSACMHCP_PEA_1_T6 (SEQ ID NO: 54) | 5037 | 5240 |
| HSACMHCP_PEA_1_T7 (SEQ ID NO: 55) | 5037 | 5240 |
| HSACMHCP_PEA_1_T8 (SEQ ID NO: 56) | 4479 | 4682 |
| HSACMHCP_PEA_1_T13 (SEQ ID NO: 57) | 3511 | 3714 |
| HSACMHCP_PEA_1_T14 (SEQ ID NO: 58) | 1617 | 1820 |
| HSACMHCP_PEA_1_T26 (SEQ ID NO: 60) | 4866 | 5069 |

Segment cluster HSACMHCP_PEA_1_node_105 (SEQ ID NO:231) according to the present invention is supported by 1 libraries. The number of libraries was determined as previously described. This segment can be found in the following transcript(s): HSACMHCP_PEA_1_T7 (SEQ ID NO:55). Table 53 below describes the starting and ending position of this segment on each transcript.

TABLE 53

Segment location on transcripts

| Transcript name | Segment starting position | Segment ending position |
| --- | --- | --- |
| HSACMHCP_PEA_1_T7 (SEQ ID NO: 55) | 5367 | 5564 |

Segment cluster HSACMHCP_PEA_1_node_106 (SEQ ID NO:232) according to the present invention is supported by 18 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 54 below describes the starting and ending position of this segment on each transcript.

TABLE 54

Segment location on transcripts

| Transcript name | Segment starting position | Segment ending position |
| --- | --- | --- |
| HSACMHCP_PEA_1_T2 (SEQ ID NO: 51) | 5367 | 5642 |
| HSACMHCP_PEA_1_T3 (SEQ ID NO: 52) | 5704 | 5979 |
| HSACMHCP_PEA_1_T4 (SEQ ID NO: 53) | 5471 | 5746 |
| HSACMHCP_PEA_1_T6 (SEQ ID NO: 54) | 5367 | 5642 |
| HSACMHCP_PEA_1_T7 (SEQ ID NO: 55) | 5565 | 5840 |
| HSACMHCP_PEA_1_T8 (SEQ ID NO: 56) | 4809 | 5084 |
| HSACMHCP_PEA_1_T13 (SEQ ID NO: 57) | 3841 | 4116 |
| HSACMHCP_PEA_1_T14 (SEQ ID NO: 58) | 1947 | 2222 |
| HSACMHCP_PEA_1_T26 (SEQ ID NO: 60) | 5196 | 5471 |

Segment cluster HSACMHCP_PEA_1_node_107 (SEQ ID NO:233) according to the present invention is supported by 5 libraries. The number of libraries was determined as previously described. This segment can be found in the following transcript(s): HSACMHCP_PEA_1_T2 (SEQ ID NO:51), HSACMHCP_PEA_1_T6 (SEQ ID NO:54), HSACMHCP_PEA_1_T7 (SEQ ID NO:55) and HSACMHCP_PEA_1_T26 (SEQ ID NO:60). Table 55 below describes the starting and ending position of this segment on each transcript.

TABLE 55

Segment location on transcripts

| Transcript name | Segment starting position | Segment ending position |
| --- | --- | --- |
| HSACMHCP_PEA_1_T2 (SEQ ID NO: 51) | 5643 | 5866 |
| HSACMHCP_PEA_1_T6 (SEQ ID NO: 54) | 5643 | 5866 |
| HSACMHCP_PEA_1_T7 (SEQ ID NO: 55) | 5841 | 6064 |
| HSACMHCP_PEA_1_T26 (SEQ ID NO: 60) | 5472 | 5695 |

Segment cluster HSACMHCP_PEA_1_node_108 (SEQ ID NO:234) according to the present invention is supported by 7 libraries. The number of libraries was determined as previously described. This segment can be found in the following transcript(s): HSACMHCP_PEA_1_T2 (SEQ ID NO:51), HSACMHCP_PEA_1_T7 (SEQ ID NO:55) and HSACMHCP_PEA_1_T26 (SEQ ID NO:60). Table 56 below describes the starting and ending position of this segment on each transcript.

TABLE 56

Segment location on transcripts

| Transcript name | Segment starting position | Segment ending position |
| --- | --- | --- |
| HSACMHCP_PEA_1_T2 (SEQ ID NO: 51) | 5867 | 6763 |
| HSACMHCP_PEA_1_T7 (SEQ ID NO: 55) | 6065 | 6961 |
| HSACMHCP_PEA_1_T26 (SEQ ID NO: 60) | 5696 | 6592 |

Segment cluster HSACMHCP_PEA_1_node_111 (SEQ ID NO:235) according to the present invention is supported by 20 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 57 below describes the starting and ending position of this segment on each transcript.

TABLE 57

Segment location on transcripts

| Transcript name | Segment starting position | Segment ending position |
| --- | --- | --- |
| HSACMHCP_PEA_1_T2 (SEQ ID NO: 51) | 6860 | 6994 |
| HSACMHCP_PEA_1_T3 (SEQ ID NO: 52) | 6076 | 6210 |
| HSACMHCP_PEA_1_T4 (SEQ ID NO: 53) | 5843 | 5977 |
| HSACMHCP_PEA_1_T6 (SEQ ID NO: 54) | 5963 | 6097 |
| HSACMHCP_PEA_1_T7 (SEQ ID NO: 55) | 7058 | 7192 |

TABLE 57-continued

Segment location on transcripts

| Transcript name | Segment starting position | Segment ending position |
|---|---|---|
| HSACMHCP_PEA_1_T8 (SEQ ID NO: 56) | 5181 | 5315 |
| HSACMHCP_PEA_1_T13 (SEQ ID NO: 57) | 4213 | 4347 |
| HSACMHCP_PEA_1_T14 (SEQ ID NO: 58) | 2319 | 2453 |
| HSACMHCP_PEA_1_T26 (SEQ ID NO: 60) | 6689 | 6823 |

Segment cluster HSACMHCP_PEA_1_node_113 (SEQ ID NO:236) according to the present invention is supported by 20 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 58 below describes the starting and ending position of this segment on each transcript.

TABLE 58

Segment location on transcripts

| Transcript name | Segment starting position | Segment ending position |
|---|---|---|
| HSACMHCP_PEA_1_T2 (SEQ ID NO: 51) | 6995 | 8921 |
| HSACMHCP_PEA_1_T3 (SEQ ID NO: 52) | 6211 | 6290 |
| HSACMHCP_PEA_1_T4 (SEQ ID NO: 53) | 5978 | 6057 |
| HSACMHCP_PEA_1_T6 (SEQ ID NO: 54) | 6098 | 6177 |
| HSACMHCP_PEA_1_T7 (SEQ ID NO: 55) | 7193 | 9119 |
| HSACMHCP_PEA_1_T8 (SEQ ID NO: 56) | 5316 | 5395 |
| HSACMHCP_PEA_1_T13 (SEQ ID NO: 57) | 4348 | 4427 |
| HSACMHCP_PEA_1_T14 (SEQ ID NO: 58) | 2454 | 2533 |
| HSACMHCP_PEA_1_T26 (SEQ ID NO: 60) | 6824 | 6903 |

According to an optional embodiment of the present invention, short segments related to the above cluster are also provided. These segments are up to about 120 bp in length, and so are included in a separate description.

Segment cluster HSACMHCP_PEA_1_node_0 (SEQ ID NO:237) according to the present invention can be found in the following transcript(s): HSACMHCP_PEA_1_T8 (SEQ ID NO:56). Table 59 below describes the starting and ending position of this segment on each transcript.

TABLE 59

Segment location on transcripts

| Transcript name | Segment starting position | Segment ending position |
|---|---|---|
| HSACMHCP_PEA_1_T8 (SEQ ID NO: 56) | 1 | 21 |

Segment cluster HSACMHCP_PEA_1_node_3 (SEQ ID NO:238) according to the present invention is supported by 10 libraries. The number of libraries was determined as previously described. This segment can be found in the following transcript(s): HSACMHCP_PEA_1_T14 (SEQ ID NO:58). Table 60 below describes the starting and ending position of this segment on each transcript.

TABLE 60

Segment location on transcripts

| Transcript name | Segment starting position | Segment ending position |
|---|---|---|
| HSACMHCP_PEA_1_T14 (SEQ ID NO: 58) | 329 | 374 |

Segment cluster HSACMHCP_PEA_1_node_4 (SEQ ID NO:239) according to the present invention can be found in the following transcript(s): HSACMHCP_PEA_1_T14 (SEQ ID NO:58). Table 61 below describes the starting and ending position of this segment on each transcript.

TABLE 61

Segment location on transcripts

| Transcript name | Segment starting position | Segment ending position |
|---|---|---|
| HSACMHCP_PEA_1_T14 (SEQ ID NO: 58) | 375 | 389 |

Segment cluster HSACMHCP_PEA_1_node_16 (SEQ ID NO:240) according to the present invention is supported by 1 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_ PEA_1_T6 (SEQ ID NO:54), HSACMHCP_PEA_1_T7 (SEQ ID NO:55), HSACMHCP_PEA_1_T17 (SEQ ID NO:59) and HSACMHCP_PEA_1_T26 (SEQ ID NO:60). Table 62 below describes the starting and ending position of this segment on each transcript.

TABLE 62

Segment location on transcripts

| Transcript name | Segment starting position | Segment ending position |
|---|---|---|
| HSACMHCP_PEA_1_T2 (SEQ ID NO: 51) | 1 | 31 |
| HSACMHCP_PEA_1_T3 (SEQ ID NO: 52) | 1 | 31 |
| HSACMHCP_PEA_1_T4 (SEQ ID NO: 53) | 1 | 31 |

TABLE 62-continued

Segment location on transcripts

| Transcript name | Segment starting position | Segment ending position |
|---|---|---|
| HSACMHCP_PEA_1_T6 (SEQ ID NO: 54) | 1 | 31 |
| HSACMHCP_PEA_1_T7 (SEQ ID NO: 55) | 1 | 31 |
| HSACMHCP_PEA_1_T17 (SEQ ID NO: 59) | 1 | 31 |
| HSACMHCP_PEA_1_T26 (SEQ ID NO: 60) | 1 | 31 |

Segment cluster HSACMHCP_PEA_1_node_18 (SEQ ID NO:241) according to the present invention is supported by 3 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T17 (SEQ ID NO:59) and HSACMHCP_PEA_1_T26 (SEQ ID NO:60). Table 63 below describes the starting and ending position of this segment on each transcript.

TABLE 63

Segment location on transcripts

| Transcript name | Segment starting position | Segment ending position |
|---|---|---|
| HSACMHCP_PEA_1_T2 (SEQ ID NO: 51) | 32 | 64 |
| HSACMHCP_PEA_1_T3 (SEQ ID NO: 52) | 32 | 64 |
| HSACMHCP_PEA_1_T4 (SEQ ID NO: 53) | 32 | 64 |
| HSACMHCP_PEA_1_T6 (SEQ ID NO: 54) | 32 | 64 |
| HSACMHCP_PEA_1_T7 (SEQ ID NO: 55) | 32 | 64 |
| HSACMHCP_PEA_1_T17 (SEQ ID NO: 59) | 32 | 64 |
| HSACMHCP_PEA_1_T26 (SEQ ID NO: 60) | 32 | 64 |

Segment cluster HSACMHCP_PEA_1_node_23 (SEQ ID NO:242) according to the present invention can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T17 (SEQ ID NO:59) and HSACMHCP_PEA_1_T26 (SEQ ID NO:60). Table 64 below describes the starting and ending position of this segment on each transcript.

TABLE 64

Segment location on transcripts

| Transcript name | Segment starting position | Segment ending position |
|---|---|---|
| HSACMHCP_PEA_1_T2 (SEQ ID NO: 51) | 401 | 422 |
| HSACMHCP_PEA_1_T3 (SEQ ID NO: 52) | 401 | 422 |
| HSACMHCP_PEA_1_T4 (SEQ ID NO: 53) | 401 | 422 |
| HSACMHCP_PEA_1_T6 (SEQ ID NO: 54) | 401 | 422 |
| HSACMHCP_PEA_1_T7 (SEQ ID NO: 55) | 401 | 422 |
| HSACMHCP_PEA_1_T17 (SEQ ID NO: 59) | 401 | 422 |
| HSACMHCP_PEA_1_T26 (SEQ ID NO: 60) | 401 | 422 |

Segment cluster HSACMHCP_PEA_1_node_27 (SEQ ID NO:243) according to the present invention is supported by 5 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T17 (SEQ ID NO:59) and HSACMHCP_PEA_1_T26 (SEQ ID NO:60). Table 65 below describes the starting and ending position of this segment on each transcript.

TABLE 65

Segment location on transcripts

| Transcript name | Segment starting position | Segment ending position |
|---|---|---|
| HSACMHCP_PEA_1_T2 (SEQ ID NO: 51) | 580 | 607 |
| HSACMHCP_PEA_1_T3 (SEQ ID NO: 52) | 580 | 607 |
| HSACMHCP_PEA_1_T4 (SEQ ID NO: 53) | 580 | 607 |
| HSACMHCP_PEA_1_T6 (SEQ ID NO: 54) | 580 | 607 |
| HSACMHCP_PEA_1_T7 (SEQ ID NO: 55) | 580 | 607 |
| HSACMHCP_PEA_1_T8 (SEQ ID NO: 56) | 22 | 49 |
| HSACMHCP_PEA_1_T17 (SEQ ID NO: 59) | 580 | 607 |
| HSACMHCP_PEA_1_T26 (SEQ ID NO: 60) | 580 | 607 |

Segment cluster HSACMHCP_PEA_1_node_29 (SEQ ID NO:244) according to the present invention is supported by 6 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T17 (SEQ ID NO:59) and HSACMHCP_PEA_1_T26 (SEQ ID NO:60). Table 66 below describes the starting and ending position of this segment on each transcript.

TABLE 66

Segment location on transcripts

| Transcript name | Segment starting position | Segment ending position |
|---|---|---|
| HSACMHCP_PEA_1_T2 (SEQ ID NO: 51) | 608 | 719 |
| HSACMHCP_PEA_1_T3 (SEQ ID NO: 52) | 608 | 719 |
| HSACMHCP_PEA_1_T4 (SEQ ID NO: 53) | 608 | 719 |
| HSACMHCP_PEA_1_T6 (SEQ ID NO: 54) | 608 | 719 |
| HSACMHCP_PEA_1_T7 (SEQ ID NO: 55) | 608 | 719 |
| HSACMHCP_PEA_1_T8 (SEQ ID NO: 56) | 50 | 161 |
| HSACMHCP_PEA_1_T17 (SEQ ID NO: 59) | 608 | 719 |
| HSACMHCP_PEA_1_T26 (SEQ ID NO: 60) | 608 | 719 |

Segment cluster HSACMHCP_PEA_1_node_31 (SEQ ID NO:245) according to the present invention is supported by 7 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T17 (SEQ ID NO:59) and HSACMHCP_PEA_1_T26 (SEQ ID NO:60). Table 67 below describes the starting and ending position of this segment on each transcript.

TABLE 67

Segment location on transcripts

| Transcript name | Segment starting position | Segment ending position |
|---|---|---|
| HSACMHCP_PEA_1_T2 (SEQ ID NO: 51) | 720 | 812 |
| HSACMHCP_PEA_1_T3 (SEQ ID NO: 52) | 720 | 812 |
| HSACMHCP_PEA_1_T4 (SEQ ID NO: 53) | 720 | 812 |
| HSACMHCP_PEA_1_T6 (SEQ ID NO: 54) | 720 | 812 |
| HSACMHCP_PEA_1_T7 (SEQ ID NO: 55) | 720 | 812 |
| HSACMHCP_PEA_1_T8 (SEQ ID NO: 56) | 162 | 254 |
| HSACMHCP_PEA_1_T17 (SEQ ID NO: 59) | 720 | 812 |
| HSACMHCP_PEA_1_T26 (SEQ ID NO: 60) | 720 | 812 |

Segment cluster HSACMHCP_PEA_1_node_33 (SEQ ID NO:246) according to the present invention is supported by 7 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T17 (SEQ ID NO:59) and HSACMHCP_PEA_1_T26 (SEQ ID NO:60). Table 68 below describes the starting and ending position of this segment on each transcript.

TABLE 68

Segment location on transcripts

| Transcript name | Segment starting position | Segment ending position |
|---|---|---|
| HSACMHCP_PEA_1_T2 (SEQ ID NO: 51) | 813 | 876 |
| HSACMHCP_PEA_1_T3 (SEQ ID NO: 52) | 813 | 876 |
| HSACMHCP_PEA_1_T4 (SEQ ID NO: 53) | 813 | 876 |
| HSACMHCP_PEA_1_T6 (SEQ ID NO: 54) | 813 | 876 |
| HSACMHCP_PEA_1_T7 (SEQ ID NO: 55) | 813 | 876 |
| HSACMHCP_PEA_1_T8 (SEQ ID NO: 56) | 255 | 318 |
| HSACMHCP_PEA_1_T17 (SEQ ID NO: 59) | 813 | 876 |
| HSACMHCP_PEA_1_T26 (SEQ ID NO: 60) | 813 | 876 |

Segment cluster HSACMHCP_PEA_1_node_35 (SEQ ID NO:247) according to the present invention is supported by 6 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T17 (SEQ ID NO:59) and HSACMHCP_PEA_1_T26 (SEQ ID NO:60). Table 69 below describes the starting and ending position of this segment on each transcript.

TABLE 69

Segment location on transcripts

| Transcript name | Segment starting position | Segment ending position |
|---|---|---|
| HSACMHCP_PEA_1_T2 (SEQ ID NO: 51) | 877 | 975 |
| HSACMHCP_PEA_1_T3 (SEQ ID NO: 52) | 877 | 975 |
| HSACMHCP_PEA_1_T4 (SEQ ID NO: 53) | 877 | 975 |
| HSACMHCP_PEA_1_T6 (SEQ ID NO: 54) | 877 | 975 |
| HSACMHCP_PEA_1_T7 (SEQ ID NO: 55) | 877 | 975 |
| HSACMHCP_PEA_1_T8 (SEQ ID NO: 56) | 319 | 417 |
| HSACMHCP_PEA_1_T17 (SEQ ID NO: 59) | 877 | 975 |
| HSACMHCP_PEA_1_T26 (SEQ ID NO: 60) | 877 | 975 |

Segment cluster HSACMHCP_PEA_1_node_37 (SEQ ID NO:248) according to the present invention is supported by 7 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T17 (SEQ ID NO:59) and HSACMHCP_PEA_1_T26 (SEQ ID NO:60). Table 70 below describes the starting and ending position of this segment on each transcript.

TABLE 70

Segment location on transcripts

| Transcript name | Segment starting position | Segment ending position |
| --- | --- | --- |
| HSACMHCP_PEA_1_T2 (SEQ ID NO: 51) | 976 | 1079 |
| HSACMHCP_PEA_1_T3 (SEQ ID NO: 52) | 976 | 1079 |
| HSACMHCP_PEA_1_T4 (SEQ ID NO: 53) | 976 | 1079 |
| HSACMHCP_PEA_1_T6 (SEQ ID NO: 54) | 976 | 1079 |
| HSACMHCP_PEA_1_T7 (SEQ ID NO: 55) | 976 | 1079 |
| HSACMHCP_PEA_1_T8 (SEQ ID NO: 56) | 418 | 521 |
| HSACMHCP_PEA_1_T17 (SEQ ID NO: 59) | 976 | 1079 |
| HSACMHCP_PEA_1_T26 (SEQ ID NO: 60) | 976 | 1079 |

Segment cluster HSACMHCP_PEA_1_node_39 (SEQ ID NO:249) according to the present invention is supported by 8 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T17 (SEQ ID NO:59) and HSACMHCP_PEA_1_T26 (SEQ ID NO:60). Table 71 below describes the starting and ending position of this segment on each transcript.

TABLE 71

Segment location on transcripts

| Transcript name | Segment starting position | Segment ending position |
| --- | --- | --- |
| HSACMHCP_PEA_1_T2 (SEQ ID NO: 51) | 1080 | 1196 |
| HSACMHCP_PEA_1_T3 (SEQ ID NO: 52) | 1080 | 1196 |
| HSACMHCP_PEA_1_T4 (SEQ ID NO: 53) | 1080 | 1196 |
| HSACMHCP_PEA_1_T6 (SEQ ID NO: 54) | 1080 | 1196 |
| HSACMHCP_PEA_1_T7 (SEQ ID NO: 55) | 1080 | 1196 |
| HSACMHCP_PEA_1_T8 (SEQ ID NO: 56) | 522 | 638 |
| HSACMHCP_PEA_1_T17 (SEQ ID NO: 59) | 1080 | 1196 |
| HSACMHCP_PEA_1_T26 (SEQ ID NO: 60) | 1080 | 1196 |

Segment cluster HSACMHCP_PEA_1_node_40 (SEQ ID NO:250) according to the present invention can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACM-HCP_ PEA_1_T7 (SEQ ID NO:55), HSACMHCP_PEA_1_T8 (SEQ ID NO:56), HSACMHCP_PEA_1_T17 (SEQ ID NO:59) and HSACMHCP_PEA_1_T26 (SEQ ID NO:60). Table 72 below describes the starting and ending position of this segment on each transcript.

TABLE 72

Segment location on transcripts

| Transcript name | Segment starting position | Segment ending position |
| --- | --- | --- |
| HSACMHCP_PEA_1_T2 (SEQ ID NO: 51) | 1197 | 1218 |
| HSACMHCP_PEA_1_T3 (SEQ ID NO: 52) | 1197 | 1218 |
| HSACMHCP_PEA_1_T4 (SEQ ID NO: 53) | 1197 | 1218 |
| HSACMHCP_PEA_1_T6 (SEQ ID NO: 54) | 1197 | 1218 |
| HSACMHCP_PEA_1_T7 (SEQ ID NO: 55) | 1197 | 1218 |
| HSACMHCP_PEA_1_T8 (SEQ ID NO: 56) | 639 | 660 |
| HSACMHCP_PEA_1_T17 (SEQ ID NO: 59) | 1197 | 1218 |
| HSACMHCP_PEA_1_T26 (SEQ ID NO: 60) | 1197 | 1218 |

Segment cluster HSACMHCP_PEA_1_node_51 (SEQ ID NO:251) according to the present invention is supported by 6 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 73 below describes the starting and ending position of this segment on each transcript.

TABLE 73

Segment location on transcripts

| Transcript name | Segment starting position | Segment ending position |
| --- | --- | --- |
| HSACMHCP_PEA_1_T2 (SEQ ID NO: 51) | 1969 | 2039 |
| HSACMHCP_PEA_1_T3 (SEQ ID NO: 52) | 1969 | 2039 |
| HSACMHCP_PEA_1_T4 (SEQ ID NO: 53) | 1969 | 2039 |
| HSACMHCP_PEA_1_T6 (SEQ ID NO: 54) | 1969 | 2039 |
| HSACMHCP_PEA_1_T7 (SEQ ID NO: 55) | 1969 | 2039 |
| HSACMHCP_PEA_1_T8 (SEQ ID NO: 56) | 1411 | 1481 |
| HSACMHCP_PEA_1_T13 (SEQ ID NO: 57) | 443 | 513 |
| HSACMHCP_PEA_1_T26 (SEQ ID NO: 60) | 1798 | 1868 |

Segment cluster HSACMHCP_PEA_1_node_53 (SEQ ID NO:252) according to the present invention is supported by 3 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 74 below describes the starting and ending position of this segment on each transcript.

TABLE 74

Segment location on transcripts

| Transcript name | Segment starting position | Segment ending position |
|---|---|---|
| HSACMHCP_PEA_1_T2 (SEQ ID NO: 51) | 2040 | 2127 |
| HSACMHCP_PEA_1_T3 (SEQ ID NO: 52) | 2040 | 2127 |
| HSACMHCP_PEA_1_T4 (SEQ ID NO: 53) | 2040 | 2127 |
| HSACMHCP_PEA_1_T6 (SEQ ID NO: 54) | 2040 | 2127 |
| HSACMHCP_PEA_1_T7 (SEQ ID NO: 55) | 2040 | 2127 |
| HSACMHCP_PEA_1_T8 (SEQ ID NO: 56) | 1482 | 1569 |
| HSACMHCP_PEA_1_T13 (SEQ ID NO: 57) | 514 | 601 |
| HSACMHCP_PEA_1_T26 (SEQ ID NO: 60) | 1869 | 1956 |

Segment cluster HSACMHCP_PEA_1_node_55 (SEQ ID NO:253) according to the present invention is supported by 2 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_ 1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 75 below describes the starting and ending position of this segment on each transcript.

TABLE 75

Segment location on transcripts

| Transcript name | Segment starting position | Segment ending position |
|---|---|---|
| HSACMHCP_PEA_1_T2 (SEQ ID NO: 51) | 2128 | 2245 |
| HSACMHCP_PEA_1_T3 (SEQ ID NO: 52) | 2128 | 2245 |
| HSACMHCP_PEA_1_T4 (SEQ ID NO: 53) | 2128 | 2245 |
| HSACMHCP_PEA_1_T6 (SEQ ID NO: 54) | 2128 | 2245 |
| HSACMHCP_PEA_1_T7 (SEQ ID NO: 55) | 2128 | 2245 |
| HSACMHCP_PEA_1_T8 (SEQ ID NO: 56) | 1570 | 1687 |
| HSACMHCP_PEA_1_T13 (SEQ ID NO: 57) | 602 | 719 |
| HSACMHCP_PEA_1_T26 (SEQ ID NO: 60) | 1957 | 2074 |

Segment cluster HSACMHCP_PEA_1_node_69 (SEQ ID NO:254) according to the present invention is supported by 8 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_ PEA_1_T6 (SEQ ID NO:54), HSACMHCP_PEA_ 1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 76 below describes the starting and ending position of this segment on each transcript.

TABLE 76

Segment location on transcripts

| Transcript name | Segment starting position | Segment ending position |
|---|---|---|
| HSACMHCP_PEA_1_T2 (SEQ ID NO: 51) | 3329 | 3419 |
| HSACMHCP_PEA_1_T3 (SEQ ID NO: 52) | 3329 | 3419 |
| HSACMHCP_PEA_1_T4 (SEQ ID NO: 53) | 3329 | 3419 |
| HSACMHCP_PEA_1_T6 (SEQ ID NO: 54) | 3329 | 3419 |
| HSACMHCP_PEA_1_T7 (SEQ ID NO: 55) | 3329 | 3419 |
| HSACMHCP_PEA_1_T8 (SEQ ID NO: 56) | 2771 | 2861 |
| HSACMHCP_PEA_1_T13 (SEQ ID NO: 57) | 1803 | 1893 |
| HSACMHCP_PEA_1_T26 (SEQ ID NO: 60) | 3158 | 3248 |

Segment cluster HSACMHCP_PEA_1_node_72 (SEQ ID NO:255) according to the present invention can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACM-HCP_ PEA_1_T7 (SEQ ID NO:55), HSACMHCP_PEA_ 1_T8 (SEQ ID NO:56), HSACMHCP_PEA_1_T13 SEQ ID NO:57) and HSACMHCP_PEA_1_T26 (SEQ ID NO:60). Table 77 below describes the starting and ending position of this segment on each transcript.

TABLE 77

Segment location on transcripts

| Transcript name | Segment starting position | Segment ending position |
|---|---|---|
| HSACMHCP_PEA_1_T2 (SEQ ID NO: 51) | 3690 | 3701 |
| HSACMHCP_PEA_1_T3 (SEQ ID NO: 52) | 3690 | 3701 |
| HSACMHCP_PEA_1_T4 (SEQ ID NO: 53) | 3690 | 3701 |
| HSACMHCP_PEA_1_T6 (SEQ ID NO: 54) | 3690 | 3701 |
| HSACMHCP_PEA_1_T7 (SEQ ID NO: 55) | 3690 | 3701 |
| HSACMHCP_PEA_1_T8 (SEQ ID NO: 56) | 3132 | 3143 |
| HSACMHCP_PEA_1_T13 (SEQ ID NO: 57) | 2164 | 2175 |
| HSACMHCP_PEA_1_T26 (SEQ ID NO: 60) | 3519 | 3530 |

Segment cluster HSACMHCP_PEA_1_node_73 (SEQ ID NO:256) according to the present invention is supported by 10 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACM-HCP_ PEA_1_T6 (SEQ ID NO:54), HSACMHCP_PEA_ 1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 78 below describes the starting and ending position of this segment on each transcript.

TABLE 78

Segment location on transcripts

| Transcript name | Segment starting position | Segment ending position |
|---|---|---|
| HSACMHCP_PEA_1_T2 (SEQ ID NO: 51) | 3702 | 3731 |
| HSACMHCP_PEA_1_T3 (SEQ ID NO: 52) | 3702 | 3731 |
| HSACMHCP_PEA_1_T4 (SEQ ID NO: 53) | 3702 | 3731 |
| HSACMHCP_PEA_1_T6 (SEQ ID NO: 54) | 3702 | 3731 |
| HSACMHCP_PEA_1_T7 (SEQ ID NO: 55) | 3702 | 3731 |
| HSACMHCP_PEA_1_T8 (SEQ ID NO: 56) | 3144 | 3173 |
| HSACMHCP_PEA_1_T13 (SEQ ID NO: 57) | 2176 | 2205 |
| HSACMHCP_PEA_1_T26 (SEQ ID NO: 60) | 3531 | 3560 |

Segment cluster HSACMHCP_PEA_1_node_74 (SEQ ID NO:257) according to the present invention is supported by 8 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57) and HSACMHCP_PEA_1_T26 (SEQ ID NO:60). Table 79 below describes the starting and ending position of this segment on each transcript.

TABLE 79

Segment location on transcripts

| Transcript name | Segment starting position | Segment ending position |
|---|---|---|
| HSACMHCP_PEA_1_T2 (SEQ ID NO: 51) | 3732 | 3809 |
| HSACMHCP_PEA_1_T3 (SEQ ID NO: 52) | 3732 | 3809 |
| HSACMHCP_PEA_1_T4 (SEQ ID NO: 53) | 3732 | 3809 |
| HSACMHCP_PEA_1_T6 (SEQ ID NO: 54) | 3732 | 3809 |
| HSACMHCP_PEA_1_T7 (SEQ ID NO: 55) | 3732 | 3809 |
| HSACMHCP_PEA_1_T8 (SEQ ID NO: 56) | 3174 | 3251 |
| HSACMHCP_PEA_1_T13 (SEQ ID NO: 57) | 2206 | 2283 |
| HSACMHCP_PEA_1_T26 (SEQ ID NO: 60) | 3561 | 3638 |

Segment cluster HSACMHCP_PEA_1_node_77 (SEQ ID NO:258) according to the present invention is supported by 12 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 80 below describes the starting and ending position of this segment on each transcript.

TABLE 80

Segment location on transcripts

| Transcript name | Segment starting position | Segment ending position |
|---|---|---|
| HSACMHCP_PEA_1_T2 (SEQ ID NO: 51) | 3810 | 3911 |
| HSACMHCP_PEA_1_T3 (SEQ ID NO: 52) | 3810 | 3911 |
| HSACMHCP_PEA_1_T4 (SEQ ID NO: 53) | 3810 | 3911 |
| HSACMHCP_PEA_1_T6 (SEQ ID NO: 54) | 3810 | 3911 |
| HSACMHCP_PEA_1_T7 (SEQ ID NO: 55) | 3810 | 3911 |
| HSACMHCP_PEA_1_T8 (SEQ ID NO: 56) | 3252 | 3353 |
| HSACMHCP_PEA_1_T13 (SEQ ID NO: 57) | 2284 | 2385 |
| HSACMHCP_PEA_1_T14 (SEQ ID NO: 58) | 390 | 491 |
| HSACMHCP_PEA_1_T26 (SEQ ID NO: 60) | 3639 | 3740 |

Segment cluster HSACMHCP_PEA_1_node_78 (SEQ ID NO:259) according to the present invention can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 81 below describes the starting and ending position of this segment on each transcript.

TABLE 81

Segment location on transcripts

| Transcript name | Segment starting position | Segment ending position |
|---|---|---|
| HSACMHCP_PEA_1_T2 (SEQ ID NO: 51) | 3912 | 3936 |
| HSACMHCP_PEA_1_T3 (SEQ ID NO: 52) | 3912 | 3936 |
| HSACMHCP_PEA_1_T4 (SEQ ID NO: 53) | 3912 | 3936 |
| HSACMHCP_PEA_1_T6 (SEQ ID NO: 54) | 3912 | 3936 |
| HSACMHCP_PEA_1_T7 (SEQ ID NO: 55) | 3912 | 3936 |
| HSACMHCP_PEA_1_T8 (SEQ ID NO: 56) | 3354 | 3378 |
| HSACMHCP_PEA_1_T13 (SEQ ID NO: 57) | 2386 | 2410 |
| HSACMHCP_PEA_1_T14 (SEQ ID NO: 58) | 492 | 516 |
| HSACMHCP_PEA_1_T26 (SEQ ID NO: 60) | 3741 | 3765 |

Segment cluster HSACMHCP_PEA_1_node_80 (SEQ ID NO:260) according to the present invention is supported by 14 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 82 below describes the starting and ending position of this segment on each transcript.

TABLE 82

Segment location on transcripts

| Transcript name | Segment starting position | Segment ending position |
|---|---|---|
| HSACMHCP_PEA_1_T2 (SEQ ID NO: 51) | 3937 | 4055 |
| HSACMHCP_PEA_1_T3 (SEQ ID NO: 52) | 3937 | 4055 |
| HSACMHCP_PEA_1_T4 (SEQ ID NO: 53) | 3937 | 4055 |
| HSACMHCP_PEA_1_T6 (SEQ ID NO: 54) | 3937 | 4055 |
| HSACMHCP_PEA_1_T7 (SEQ ID NO: 55) | 3937 | 4055 |
| HSACMHCP_PEA_1_T8 (SEQ ID NO: 56) | 3379 | 3497 |
| HSACMHCP_PEA_1_T13 (SEQ ID NO: 57) | 2411 | 2529 |
| HSACMHCP_PEA_1_T14 (SEQ ID NO: 58) | 517 | 635 |
| HSACMHCP_PEA_1_T26 (SEQ ID NO: 60) | 3766 | 3884 |

Segment cluster HSACMHCP_PEA_1_node_82 (SEQ ID NO:261) according to the present invention can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_ PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 83 below describes the starting and ending position of this segment on each transcript.

TABLE 83

Segment location on transcripts

| Transcript name | Segment starting position | Segment ending position |
|---|---|---|
| HSACMHCP_PEA_1_T2 (SEQ ID NO: 51) | 4056 | 4079 |
| HSACMHCP_PEA_1_T3 (SEQ ID NO: 52) | 4393 | 4416 |
| HSACMHCP_PEA_1_T4 (SEQ ID NO: 53) | 4056 | 4079 |
| HSACMHCP_PEA_1_T6 (SEQ ID NO: 54) | 4056 | 4079 |
| HSACMHCP_PEA_1_T7 (SEQ ID NO: 55) | 4056 | 4079 |
| HSACMHCP_PEA_1_T8 (SEQ ID NO: 56) | 3498 | 3521 |
| HSACMHCP_PEA_1_T13 (SEQ ID NO: 57) | 2530 | 2553 |
| HSACMHCP_PEA_1_T14 (SEQ ID NO: 58) | 636 | 659 |
| HSACMHCP_PEA_1_T26 (SEQ ID NO: 60) | 3885 | 3908 |

Segment cluster HSACMHCP_PEA_1_node_83 (SEQ ID NO:262) according to the present invention is supported by 12 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 84 below describes the starting and ending position of this segment on each transcript.

TABLE 84

Segment location on transcripts

| Transcript name | Segment starting position | Segment ending position |
|---|---|---|
| HSACMHCP_PEA_1_T2 (SEQ ID NO: 51) | 4080 | 4145 |
| HSACMHCP_PEA_1_T3 (SEQ ID NO: 52) | 4417 | 4482 |
| HSACMHCP_PEA_1_T4 (SEQ ID NO: 53) | 4080 | 4145 |
| HSACMHCP_PEA_1_T6 (SEQ ID NO: 54) | 4080 | 4145 |
| HSACMHCP_PEA_1_T7 (SEQ ID NO: 55) | 4080 | 4145 |
| HSACMHCP_PEA_1_T8 (SEQ ID NO: 56) | 3522 | 3587 |
| HSACMHCP_PEA_1_T13 (SEQ ID NO: 57) | 2554 | 2619 |
| HSACMHCP_PEA_1_T14 (SEQ ID NO: 58) | 660 | 725 |
| HSACMHCP_PEA_1_T26 (SEQ ID NO: 60) | 3909 | 3974 |

Segment cluster HSACMHCP_PEA_1_node_84 (SEQ ID NO:263) according to the present invention is supported by 9 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 85 below describes the starting and ending position of this segment on each transcript.

TABLE 85

Segment location on transcripts

| Transcript name | Segment starting position | Segment ending position |
| --- | --- | --- |
| HSACMHCP_PEA_1_T2 (SEQ ID NO: 51) | 4146 | 4217 |
| HSACMHCP_PEA_1_T3 (SEQ ID NO: 52) | 4483 | 4554 |
| HSACMHCP_PEA_1_T4 (SEQ ID NO: 53) | 4146 | 4217 |
| HSACMHCP_PEA_1_T6 (SEQ ID NO: 54) | 4146 | 4217 |
| HSACMHCP_PEA_1_T7 (SEQ ID NO: 55) | 4146 | 4217 |
| HSACMHCP_PEA_1_T8 (SEQ ID NO: 56) | 3588 | 3659 |
| HSACMHCP_PEA_1_T13 (SEQ ID NO: 57) | 2620 | 2691 |
| HSACMHCP_PEA_1_T14 (SEQ ID NO: 58) | 726 | 797 |
| HSACMHCP_PEA_1_T26 (SEQ ID NO: 60) | 3975 | 4046 |

Segment cluster HSACMHCP_PEA_1_node_85 (SEQ ID NO:264) according to the present invention is supported by 10 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 86 below describes the starting and ending position of this segment on each transcript.

TABLE 86

Segment location on transcripts

| Transcript name | Segment starting position | Segment ending position |
| --- | --- | --- |
| HSACMHCP_PEA_1_T2 (SEQ ID NO: 51) | 4218 | 4252 |
| HSACMHCP_PEA_1_T3 (SEQ ID NO: 52) | 4555 | 4589 |
| HSACMHCP_PEA_1_T4 (SEQ ID NO: 53) | 4218 | 4252 |
| HSACMHCP_PEA_1_T6 (SEQ ID NO: 54) | 4218 | 4252 |
| HSACMHCP_PEA_1_T7 (SEQ ID NO: 55) | 4218 | 4252 |
| HSACMHCP_PEA_1_T8 (SEQ ID NO: 56) | 3660 | 3694 |
| HSACMHCP_PEA_1_T13 (SEQ ID NO: 57) | 2692 | 2726 |
| HSACMHCP_PEA_1_T14 (SEQ ID NO: 58) | 798 | 832 |
| HSACMHCP_PEA_1_T26 (SEQ ID NO: 60) | 4047 | 4081 |

Segment cluster HSACMHCP_PEA_1_node_90 (SEQ ID NO:265) according to the present invention is supported by 2 libraries. The number of libraries was determined as previously described. This segment can be found in the following transcript(s): HSACMHCP_PEA_1_T4 (SEQ ID NO:53). Table 87 below describes the starting and ending position of this segment on each transcript.

TABLE 87

Segment location on transcripts

| Transcript name | Segment starting position | Segment ending position |
| --- | --- | --- |
| HSACMHCP_PEA_1_T4 (SEQ ID NO: 53) | 4603 | 4706 |

Segment cluster HSACMHCP_PEA_1_node_91 (SEQ ID NO:266) according to the present invention is supported by 12 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 88 below describes the starting and ending position of this segment on each transcript.

TABLE 88

Segment location on transcripts

| Transcript name | Segment starting position | Segment ending position |
| --- | --- | --- |
| HSACMHCP_PEA_1_T2 (SEQ ID NO: 51) | 4603 | 4679 |
| HSACMHCP_PEA_1_T3 (SEQ ID NO: 52) | 4940 | 5016 |
| HSACMHCP_PEA_1_T4 (SEQ ID NO: 53) | 4707 | 4783 |
| HSACMHCP_PEA_1_T6 (SEQ ID NO: 54) | 4603 | 4679 |
| HSACMHCP_PEA_1_T7 (SEQ ID NO: 55) | 4603 | 4679 |
| HSACMHCP_PEA_1_T8 (SEQ ID NO: 56) | 4045 | 4121 |
| HSACMHCP_PEA_1_T13 (SEQ ID NO: 57) | 3077 | 3153 |
| HSACMHCP_PEA_1_T14 (SEQ ID NO: 58) | 1183 | 1259 |
| HSACMHCP_PEA_1_T26 (SEQ ID NO: 60) | 4432 | 4508 |

Segment cluster HSACMHCP_PEA_1_node_92 (SEQ ID NO:267) according to the present invention can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 89 below desribes the starting and ending position of this segment on each transcript.

TABLE 89

Segment location on transcripts

| Transcript name | Segment starting position | Segment ending position |
| --- | --- | --- |
| HSACMHCP_PEA_1_T2 (SEQ ID NO: 51) | 4680 | 4700 |
| HSACMHCP_PEA_1_T3 (SEQ ID NO: 52) | 5017 | 5037 |

TABLE 89-continued

Segment location on transcripts

| Transcript name | Segment starting position | Segment ending position |
|---|---|---|
| HSACMHCP_PEA_1_T4 (SEQ ID NO: 53) | 4784 | 4804 |
| HSACMHCP_PEA_1_T6 (SEQ ID NO: 54) | 4680 | 4700 |
| HSACMHCP_PEA_1_T7 (SEQ ID NO: 55) | 4680 | 4700 |
| HSACMHCP_PEA_1_T8 (SEQ ID NO: 56) | 4122 | 4142 |
| HSACMHCP_PEA_1_T13 (SEQ ID NO: 57) | 3154 | 3174 |
| HSACMHCP_PEA_1_T14 (SEQ ID NO: 58) | 1260 | 1280 |
| HSACMHCP_PEA_1_T26 (SEQ ID NO: 60) | 4509 | 4529 |

Segment cluster HSACMHCP_PEA_1_node_93 (SEQ ID NO:268) according to the present invention is supported by 14 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 90 below describes the starting and ending position of this segment on each transcript.

TABLE 90

Segment location on transcripts

| Transcript name | Segment starting position | Segment ending position |
|---|---|---|
| HSACMHCP_PEA_1_T2 (SEQ ID NO: 51) | 4701 | 4727 |
| HSACMHCP_PEA_1_T3 (SEQ ID NO: 52) | 5038 | 5064 |
| HSACMHCP_PEA_1_T4 (SEQ ID NO: 53) | 4805 | 4831 |
| HSACMHCP_PEA_1_T6 (SEQ ID NO: 54) | 4701 | 4727 |
| HSACMHCP_PEA_1_T7 (SEQ ID NO: 55) | 4701 | 4727 |
| HSACMHCP_PEA_1_T8 (SEQ ID NO: 56) | 4143 | 4169 |
| HSACMHCP_PEA_1_T13 (SEQ ID NO: 57) | 3175 | 3201 |
| HSACMHCP_PEA_1_T14 (SEQ ID NO: 58) | 1281 | 1307 |
| HSACMHCP_PEA_1_T26 (SEQ ID NO: 60) | 4530 | 4556 |

Segment cluster HSACMHCP_PEA_1_node_95 (SEQ ID NO:269) according to the present invention can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_ PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 91 below desribes the starting and ending position of this segment on each transcript.

TABLE 91

Segment location on transcripts

| Transcript name | Segment starting position | Segment ending position |
|---|---|---|
| HSACMHCP_PEA_1_T2 (SEQ ID NO: 51) | 4728 | 4742 |
| HSACMHCP_PEA_1_T3 (SEQ ID NO: 52) | 5065 | 5079 |
| HSACMHCP_PEA_1_T4 (SEQ ID NO: 53) | 4832 | 4846 |
| HSACMHCP_PEA_1_T6 (SEQ ID NO: 54) | 4728 | 4742 |
| HSACMHCP_PEA_1_T7 (SEQ ID NO: 55) | 4728 | 4742 |
| HSACMHCP_PEA_1_T8 (SEQ ID NO: 56) | 4170 | 4184 |
| HSACMHCP_PEA_1_T13 (SEQ ID NO: 57) | 3202 | 3216 |
| HSACMHCP_PEA_1_T14 (SEQ ID NO: 58) | 1308 | 1322 |
| HSACMHCP_PEA_1_T26 (SEQ ID NO: 60) | 4557 | 4571 |

Segment cluster HSACMHCP_PEA_1_node_98 (SEQ ID NO:270) according to the present invention is supported by 15 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_ PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 92 below describes the starting and ending position of this segment on each transcript.

TABLE 92

Segment location on transcripts

| Transcript name | Segment starting position | Segment ending position |
|---|---|---|
| HSACMHCP_PEA_1_T2 (SEQ ID NO: 51) | 5007 | 5036 |
| HSACMHCP_PEA_1_T3 (SEQ ID NO: 52) | 5344 | 5373 |
| HSACMHCP_PEA_1_T4 (SEQ ID NO: 53) | 5111 | 5140 |
| HSACMHCP_PEA_1_T6 (SEQ ID NO: 54) | 5007 | 5036 |
| HSACMHCP_PEA_1_T7 (SEQ ID NO: 55) | 5007 | 5036 |
| HSACMHCP_PEA_1_T8 (SEQ ID NO: 56) | 4449 | 4478 |
| HSACMHCP_PEA_1_T13 (SEQ ID NO: 57) | 3481 | 3510 |
| HSACMHCP_PEA_1_T14 (SEQ ID NO: 58) | 1587 | 1616 |
| HSACMHCP_PEA_1_T26 (SEQ ID NO: 60) | 4836 | 4865 |

Segment cluster HSACMHCP_PEA_1_node_103 (SEQ ID NO:271) according to the present invention is supported by 18 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 93 below describes the starting and ending position of this segment on each transcript.

TABLE 93

Segment location on transcripts

| Transcript name | Segment starting position | Segment ending position |
|---|---|---|
| HSACMHCP_PEA_1_T2 (SEQ ID NO: 51) | 5241 | 5297 |
| HSACMHCP_PEA_1_T3 (SEQ ID NO: 52) | 5578 | 5634 |
| HSACMHCP_PEA_1_T4 (SEQ ID NO: 53) | 5345 | 5401 |
| HSACMHCP_PEA_1_T6 (SEQ ID NO: 54) | 5241 | 5297 |
| HSACMHCP_PEA_1_T7 (SEQ ID NO: 55) | 5241 | 5297 |
| HSACMHCP_PEA_1_T8 (SEQ ID NO: 56) | 4683 | 4739 |
| HSACMHCP_PEA_1_T13 (SEQ ID NO: 57) | 3715 | 3771 |
| HSACMHCP_PEA_1_T14 (SEQ ID NO: 58) | 1821 | 1877 |
| HSACMHCP_PEA_1_T26 (SEQ ID NO: 60) | 5070 | 5126 |

Segment cluster HSACMHCP_PEA_1_node_104 (SEQ ID NO:272) according to the present invention is supported by 18 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 94 below describes the starting and ending position of this segment on each transcript.

TABLE 94

Segment location on transcripts

| Transcript name | Segment starting position | Segment ending position |
|---|---|---|
| HSACMHCP_PEA_1_T2 (SEQ ID NO: 51) | 5298 | 5366 |
| HSACMHCP_PEA_1_T3 (SEQ ID NO: 52) | 5635 | 5703 |
| HSACMHCP_PEA_1_T4 (SEQ ID NO: 53) | 5402 | 5470 |
| HSACMHCP_PEA_1_T6 (SEQ ID NO: 54) | 5298 | 5366 |
| HSACMHCP_PEA_1_T7 (SEQ ID NO: 55) | 5298 | 5366 |
| HSACMHCP_PEA_1_T8 (SEQ ID NO: 56) | 4740 | 4808 |
| HSACMHCP_PEA_1_T13 (SEQ ID NO: 57) | 3772 | 3840 |

TABLE 94-continued

Segment location on transcripts

| Transcript name | Segment starting position | Segment ending position |
|---|---|---|
| HSACMHCP_PEA_1_T14 (SEQ ID NO: 58) | 1878 | 1946 |
| HSACMHCP_PEA_1_T26 (SEQ ID NO: 60) | 5127 | 5195 |

Segment cluster HSACMHCP_PEA_1_node_109 (SEQ ID NO:273) according to the present invention is supported by 18 libraries. The number of libraries was determined as previously described. This segment can be found in the following transcript(s): HSACMHCP_PEA_1_T2 (SEQ ID NO:51), HSACMHCP_PEA_1_T3 (SEQ ID NO:52), HSACMHCP_PEA_1_T4 (SEQ ID NO:53), HSACMHCP_PEA_1_T6 (SEQ ID NO:54), HSACMHCP_PEA_1_T7 (SEQ ID NO:55), HSACMHCP_PEA_1_T8 (SEQ ID NO:56), HSACMHCP_PEA_1_T13 (SEQ ID NO:57), HSACMHCP_PEA_1_T14 (SEQ ID NO:58) and HSACMHCP_PEA_1_T26 (SEQ ID NO:60). Table 95 below describes the starting and ending position of this segment on each transcript.

TABLE 95

Segment location on transcripts

| Transcript name | Segment starting position | Segment ending position |
|---|---|---|
| HSACMHCP_PEA_1_T2 (SEQ ID NO: 51) | 6764 | 6859 |
| HSACMHCP_PEA_1_T3 (SEQ ID NO: 52) | 5980 | 6075 |
| HSACMHCP_PEA_1_T4 (SEQ ID NO: 53) | 5747 | 5842 |
| HSACMHCP_PEA_1_T6 (SEQ ID NO: 54) | 5867 | 5962 |
| HSACMHCP_PEA_1_T7 (SEQ ID NO: 55) | 6962 | 7057 |
| HSACMHCP_PEA_1_T8 (SEQ ID NO: 56) | 5085 | 5180 |
| HSACMHCP_PEA_1_T13 (SEQ ID NO: 57) | 4117 | 4212 |
| HSACMHCP_PEA_1_T14 (SEQ ID NO: 58) | 2223 | 2318 |
| HSACMHCP_PEA_1_T26 (SEQ ID NO: 60) | 6593 | 6688 |

Variant protein alignment to the previously known protein:
Sequence name: MYH6_HUMAN_V1 (SEQ ID NO:338)
Sequence documentation:
Alignment of: HSACMHCP_PEA_1_P2 (SEQ ID NO:326)×MYH6—HUMAN_V1 (SEQ ID NO:338)

| Alignment segment 1/1: | | | |
|---|---|---|---|
| Quality: | 17978.00 | Escore: | 0 |
| Matching length: | 1855 | Total length: | 1855 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MTDAQMADFGAAAQYLRKSEKERLEAQTRPFDIRTECFVPDDKEEFVKAK   50
     ||||||||||||||||||||||||||||||||||||||||||||||||||
  1  MTDAQMADFGAAAQYLRKSEKERLEAQTRPFDIRTECFVPDDKEEFVKAK   50

51  ILSREGGKVIAETENGKTVTVKEDQVLQQNPPKFDKIEDMAMLTFLHEPA  100
     ||||||||||||||||||||||||||||||||||||||||||||||||||
 51  ILSREGGKVIAETENGKTVTVKEDQVLQQNPPKFDKIEDMAMLTFLHEPA  100

101  VLFNLKERYAAWMIYTYSGLFCVTVNPYKWLPVYNAEVVAAYRGKKRSEA  150
     ||||||||||||||||||||||||||||||||||||||||||||||||||
101  VLFNLKERYAAWMIYTYSGLFCVTVNPYKWLPVYNAEVVAAYRGKKRSEA  150

151  PPHIFSISDNAYQYMLTDRENQSILITGESGAGKTVNTKRVIQYFASIAA  200
     ||||||||||||||||||||||||||||||||||||||||||||||||||
151  PPHIFSISDNAYQYMLTDRENQSILITGESGAGKTVNTKRVIQYFASIAA  200

201  IGDRGKKDNANANKGTLEDQIIQANPALEAFGNAKTVRNDNSSRFGKFIR  250
     ||||||||||||||||||||||||||||||||||||||||||||||||||
201  IGDRGKKDNANANKGTLEDQIIQANPALEAFGNAKTVRNDNSSRFGKFIR  250

251  IHFGATGKLASADIETYLLEKSRVIFQLKAERNYHIFYQILSNKKPELLD  300
     ||||||||||||||||||||||||||||||||||||||||||||||||||
251  IHFGATGKLASADIETYLLEKSRVIFQLKAERNYHIFYQILSNKKPELLD  300

301  MLLVTNNPYDYAFVSQGEVSVASIDDSEELMATDSAFDVLGFTSEEKAGV  350
     ||||||||||||||||||||||||||||||||||||||||||||||||||
301  MLLVTNNPYDYAFVSQGEVSVASIDDSEELMATDSAFDVLGFTSEEKAGV  350

351  YKLTGAIMHYGNMKFKQKQREEQAEPDGTEDADKSAYLMGLNSADLLKGL  400
     ||||||||||||||||||||||||||||||||||||||||||||||||||
351  YKLTGAIMHYGNMKFKQKQREEQAEPDGTEDADKSAYLMGLNSADLLKGL  400

401  CHPRVKVGNEYVTKGQSVQQVYYSIGALAKAVYEKMFNWMVTRINATLET  450
     ||||||||||||||||||||||||||||||||||||||||||||||||||
401  CHPRVKVGNEYVTKGQSVQQVYYSIGALAKAVYEKMFNWMVTRINATLET  450

451  KQPRQYFIGVLDIAGFEIFDFNSFEQLCINFTNEKLQQFFNHHMFVLEQE  500
     ||||||||||||||||||||||||||||||||||||||||||||||||||
451  KQPRQYFIGVLDIAGFEIFDFNSFEQLCINFTNEKLQQFFNHHMFVLEQE  500

501  EYKKEGIEWTFIDFGMDLQACIDLIEKPMGIMSILEEECMFPKATDMTFK  550
     ||||||||||||||||||||||||||||||||||||||||||||||||||
501  EYKKEGIEWTFIDFGMDLQACIDLIEKPMGIMSILEEECMFPKATDMTFK  550

551  AKLYDNHLGKSNNFQKPRNIKGKQEAHFSLIHYAGTVDYNILGWLEKNKD  600
     ||||||||||||||||||||||||||||||||||||||||||||||||||
551  AKLYDNHLGKSNNFQKPRNIKGKQEAHFSLIHYAGTVDYNILGWLEKNKD  600

601  PLNETVVALYQKSSLKLMATLFSSYATADTGDSGKSKGGKKKGSSFQTVS  650
     ||||||||||||||||||||||||||||||||||||||||||||||||||
601  PLNETVVALYQKSSLKLMATLFSSYATADTGDSGKSKGGKKKGSSFQTVS  650

651  ALHRENLNKLMTNLRTTHPHFVRCIIPNERKAPGVMDNPLVMHQLRCNGV  700
     ||||||||||||||||||||||||||||||||||||||||||||||||||
651  ALHRENLNKLMTNLRTTHPHFVRCIIPNERKAPGVMDNPLVMHQLRCNGV  700

701  LEGIRICRKGFPNRILYGDFRQRYRILNPVAIPEGQFIDSRKGTEKLLSS  750
     ||||||||||||||||||||||||||||||||||||||||||||||||||
701  LEGIRICRKGFPNRILYGDFRQRYRILNPVAIPEGQFIDSRKGTEKLLSS  750

751  LDIDHNQYKFGHTKVFFKAGLLGLLEEMRDERLSRIITRMQAQARGQLMR  800
     ||||||||||||||||||||||||||||||||||||||||||||||||||
751  LDIDHNQYKFGHTKVFFKAGLLGLLEEMRDERLSRIITRMQAQARGQLMR  800

801  IEFKKIVERRDALLVIQWNIRAFMGVKNWPWMKLYFKIKPLLKSAETEKE  850
     ||||||||||||||||||||||||||||||||||||||||||||||||||
801  IEFKKIVERRDALLVIQWNIRAFMGVKNWPWMKLYFKIKPLLKSAETEKE  850

851  MATMKEEFGRIKETLEKSEARRKELEEKMVSLLQEKNDLQLQVQAEQDNL  900
     ||||||||||||||||||||||||||||||||||||||||||||||||||
851  MATMKEEFGRIKETLEKSEARRKELEEKMVSLLQEKNDLQLQVQAEQDNL  900

901  NDAEERCDQLIKNKIQLEAKVKEMNERLEDEEEMNAELTAKKRKLEDECS  950
     ||||||||||||||||||||||||||||||||||||||||||||||||||
901  NDAEERCDQLIKNKIQLEAKVKEMNERLEDEEEMNAELTAKKRKLEDECS  950

951  ELKKDIDDLELTLAKVEKEKHATENKVKNLTEEMAGLDEIIAKLTKEKKA 1000
     ||||||||||||||||||||||||||||||||||||||||||||||||||
951  ELKKDIDDLELTLAKVEKEKHATENKVKNLTEEMAGLDEIIAKLTKEKKA 1000
```

```
1001  LQEAHQQALDDLQVEEDKVNSLSKSKVKLEQQVDDLEGSLEQEKKVRMDL  1050
      ||||||||||||||||||||||||||||||||||||||||||||||||||
1001  LQEAHQQALDDLQVEEDKVNSLSKSKVKLEQQVDDLEGSLEQEKKVRMDL  1050

1051  ERAKRKLEGDLKLTQESIMDLENDKLQLEEKLKKKEFDINQQNSKIEDEQ  1100
      ||||||||||||||||||||||||||||||||||||||||||||||||||
1051  ERAKRKLEGDLKLTQESIMDLENDKLQLEEKLKKKEFDINQQNSKIEDEQ  1100

1101  ALALQLQKKLKENQARIEELEEELEAERTARAKVEKLRSDLSRELEEISE  1150
      ||||||||||||||||||||||||||||||||||||||||||||||||||
1101  ALALQLQKKLKENQARIEELEEELEAERTARAKVEKLRSDLSRELEEISE  1150

1151  RLEEAGGATSVQIEMNKKREAEFQKMRRDLEEATLQHEATAAALRKKHAD  1200
      ||||||||||||||||||||||||||||||||||||||||||||||||||
1151  RLEEAGGATSVQIEMNKKREAEFQKMRRDLEEATLQHEATAAALRKKHAD  1200

1201  SVAELGEQIDNLQRVKQKLEKEKSEFKLELDDVTSNMEQIIKAKANLEKV  1250
      ||||||||||||||||||||||||||||||||||||||||||||||||||
1201  SVAELGEQIDNLQRVKQKLEKEKSEFKLELDDVTSNMEQIIKAKANLEKV  1250

1251  SRTLEDQANEYRVKLEEAQRSLNDFTTQRAKLQTENGELARQLEEKEALI  1300
      ||||||||||||||||||||||||||||||||||||||||||||||||||
1251  SRTLEDQANEYRVKLEEAQRSLNDFTTQRAKLQTENGELARQLEEKEALI  1300

1301  SQLTRGKLSYTQQMEDLKRQLEEEGKAKNALAHALQSARHDCDLLREQYE  1350
      ||||||||||||||||||||||||||||||||||||||||||||||||||
1301  SQLTRGKLSYTQQMEDLKRQLEEEGKAKNALAHALQSARHDCDLLREQYE  1350

1351  EETEAKAELQRVLSKANSEVAQWRTKYETDAIQRTEELEEAKKKLAQRLQ  1400
      ||||||||||||||||||||||||||||||||||||||||||||||||||
1351  EETEAKAELQRVLSKANSEVAQWRTKYETDAIQRTEELEEAKKKLAQRLQ  1400

1401  DAEEAVEAVNAKCSSLEKTKHRLQNEIEDLMVDVERSNAAAAALDKKQRN  1450
      ||||||||||||||||||||||||||||||||||||||||||||||||||
1401  DAEEAVEAVNAKCSSLEKTKHRLQNEIEDLMVDVERSNAAAAALDKKQRN  1450

1451  FDKILAEWKQKYEESQSELESSQKEARSLSTELFKLKNAYEESLEHLETF  1500
      ||||||||||||||||||||||||||||||||||||||||||||||||||
1451  FDKILAEWKQKYEESQSELESSQKEARSLSTELFKLKNAYEESLEHLETF  1500

1501  KRENKNLQEEISDLTEQLGEGGKNVHELEKVRKQLEVEKLELQSALEEAE  1550
      ||||||||||||||||||||||||||||||||||||||||||||||||||
1501  KRENKNLQEEISDLTEQLGEGGKNVHELEKVRKQLEVEKLELQSALEEAE  1550

1551  ASLEHEEGKILRAQLEFNQIKAEIERKLAEKDEEMEQAKRNHQRVVDSLQ  1600
      ||||||||||||||||||||||||||||||||||||||||||||||||||
1551  ASLEHEEGKILRAQLEFNQIKAEIERKLAEKDEEMEQAKRNHQRVVDSLQ  1600

1601  TSLDAETRSRNEVLRVKKKMEGDLNEMEIQLSHANRMAAEAQKQVKSLQS  1650
      ||||||||||||||||||||||||||||||||||||||||||||||||||
1601  TSLDAETRSRNEVLRVKKKMEGDLNEMEIQLSHANRMAAEAQKQVKSLQS  1650

1651  LLKDTQIQLDDAVRANDDLKENIAIVERRNNLLQAELEELRAVVEQTERS  1700
      ||||||||||||||||||||||||||||||||||||||||||||||||||
1651  LLKDTQIQLDDAVRANDDLKENIAIVERRNNLLQAELEELRAVVEQTERS  1700

1701  RKLAEQELIETSERVQLLHSQNTSLINQKKKMESDLTQLQSEVEEAVQEC  1750
      ||||||||||||||||||||||||||||||||||||||||||||||||||
1701  RKLAEQELIETSERVQLLHSQNTSLINQKKKMESDLTQLQSEVEEAVQEC  1750

1751  RNAEEKAKKAITDAAMMAEELKKEQDTSAHLERMKKNMEQTIKDLQHRLD  1800
      ||||||||||||||||||||||||||||||||||||||||||||||||||
1751  RNAEEKAKKAITDAAMMAEELKKEQDTSAHLERMKKNMEQTIKDLQHRLD  1800

1801  EAEQIALKGGKKQLQKLEARVRELEGELEAEQKRNAESVKGMRKSERRIK  1850
      ||||||||||||||||||||||||||||||||||||||||||||||||||
1801  EAEQIALKGGKKQLQKLEARVRELEGELEAEQKRNAESVKGMRKSERRIK  1850

1851  ELTYQ  1855
      |||||
1851  ELTYQ  1855
```

Sequence name: MYH6_HUMAN_V2 (SEQ ID NO:339)

Sequence documentation:

Alignment of: HSACMHCP_PEA_1_P3 (SEQ ID NO:327)×MYH6—HUMAN_V2 (SEQ ID NO:339)

Alignment segment 1/1:

| | | | |
|---|---|---|---|
| Quality: | 12901.00 | Escore: | 0 |
| Matching length: | 1328 | Total length: | 1328 |
| Matching Percent Similarity: | 99.92 | Matching Percent Identity: | 99.85 |
| Total Percent Similarity: | 99.92 | Total Percent Identity: | 99.85 |
| Gaps: | 0 | | |

Alignment:

```
  1  MTDAQMADFGAAAQYLRKSEKERLEAQTRPFDIRTECFVPDDKEEFVKAK   50
     ||||||||||||||||||||||||||||||||||||||||||||||||||
  1  MTDAQMADFGAAAQYLRKSEKERLEAQTRPFDIRTECFVPDDKEEFVKAK   50

51  ILSREGGKVIAETENGKTVTVKEDQVLQQNPPKFDKIEDMAMLTFLHEPA  100
     ||||||||||||||||||||||||||||||||||||||||||||||||||
 51  ILSREGGKVIAETENGKTVTVKEDQVLQQNPPKFDKIEDMAMLTFLHEPA  100

101  VLFNLKERYAAWMIYTYSGLFCVTVNPYKWLPVYNAEVVAAYRGKKRSEA  150
     ||||||||||||||||||||||||||||||||||||||||||||||||||
101  VLFNLKERYAAWMIYTYSGLFCVTVNPYKWLPVYNAEVVAAYRGKKRSEA  150

151  PPHIFSISDNAYQYMLTDRENQSILITGESGAGKTVNTKRVIQYFASIAA  200
     ||||||||||||||||||||||||||||||||||||||||||||||||||
151  PPHIFSISDNAYQYMLTDRENQSILITGESGAGKTVNTKRVIQYFASIAA  200

201  IGDRGKKDNANANKGTLEDQIIQANPALEAFGNAKTVRNDNSSRFGKFIR  250
     ||||||||||||||||||||||||||||||||||||||||||||||||||
201  IGDRGKKDNANANKGTLEDQIIQANPALEAFGNAKTVRNDNSSRFGKFIR  250

251  IHFGATGKLASADIETYLLEKSRVIFQLKAERNYHIFYQILSNKKPELLD  300
     ||||||||||||||||||||||||||||||||||||||||||||||||||
251  IHFGATGKLASADIETYLLEKSRVIFQLKAERNYHIFYQILSNKKPELLD  300

301  MLLVTNNPYDYAFVSQGEVSVASIDDSEELMATDSAFDVLGFTSEEKAGV  350
     ||||||||||||||||||||||||||||||||||||||||||||||||||
301  MLLVTNNPYDYAFVSQGEVSVASIDDSEELMATDSAFDVLGFTSEEKAGV  350

351  YKLTGAIMHYGNMKFKQKQREEQAEPDGTEDADKSAYLMGLNSADLLKGL  400
     ||||||||||||||||||||||||||||||||||||||||||||||||||
351  YKLTGAIMHYGNMKFKQKQREEQAEPDGTEDADKSAYLMGLNSADLLKGL  400

401  CHPRVKVGNEYVTKGQSVQQVYYSIGALAKAVYEKMFNWMVTRINATLET  450
     ||||||||||||||||||||||||||||||||||||||||||||||||||
401  CHPRVKVGNEYVTKGQSVQQVYYSIGALAKAVYEKMFNWMVTRINATLET  450

451  KQPRQYFIGVLDIAGFEIFDFNSFEQLCINFTNEKLQQFFNHHMFVLEQE  500
     ||||||||||||||||||||||||||||||||||||||||||||||||||
451  KQPRQYFIGVLDIAGFEIFDFNSFEQLCINFTNEKLQQFFNHHMFVLEQE  500

501  EYKKEGIEWTFIDFGMDLQACIDLIEKPMGIMSILEEECMFPKATDMTFK  550
     ||||||||||||||||||||||||||||||||||||||||||||||||||
501  EYKKEGIEWTFIDFGMDLQACIDLIEKPMGIMSILEEECMFPKATDMTFK  550

551  AKLYDNHLGKSNNFQKPRNIKGKQEAHFSLIHYAGTVDYNILGWLEKNKD  600
     ||||||||||||||||||||||||||||||||||||||||||||||||||
551  AKLYDNHLGKSNNFQKPRNIKGKQEAHFSLIHYAGTVDYNILGWLEKNKD  600

601  PLNETVVALYQKSSLKLMATLFSSYATADTGDSGKSKGGKKKGSSFQTVS  650
     ||||||||||||||||||||||||||||||||||||||||||||||||||
601  PLNETVVALYQKSSLKLMATLFSSYATADTGDSGKSKGGKKKGSSFQTVS  650

651  ALHRENLNKLMTNLRTTHPHFVRCIIPNERKAPGVMDNPLVMHQLRCNGV  700
     ||||||||||||||||||||||||||||||||||||||||||||||||||
651  ALHRENLNKLMTNLRTTHPHFVRCIIPNERKAPGVMDNPLVMHQLRCNGV  700

701  LEGIRICRKGFPNRILYGDFRQRYRILNPVAIPEGQFIDSRKGTEKLLSS  750
     ||||||||||||||||||||||||||||||||||||||||||||||||||
701  LEGIRICRKGFPNRILYGDFRQRYRILNPVAIPEGQFIDSRKGTEKLLSS  750

751  LDIDHNQYKFGHTKVFFKAGLLGLLEEMRDERLSRIITRMQAQARGQLMR  800
     ||||||||||||||||||||||||||||||||||||||||||||||||||
751  LDIDHNQYKFGHTKVFFKAGLLGLLEEMRDERLSRIITRMQAQARGQLMR  800
```

-continued

```
 801  IEFKKIVERRDALLVIQWNIRAFMGVKNWPWMKLYFKIKPLLKSAETEKE   850
      ||||||||||||||||||||||||||||||||||||||||||||||||||
 801  IEFKKIVERRDALLVIQWNIRAFMGVKNWPWMKLYFKIKPLLKSAETEKE   850

851  MATMKEEFGRIKETLEKSEARRKELEEKMVSLLQEKNDLQLQVQAEQDNL   900
      ||||||||||||||||||||||||||||||||||||||||||||||||||
 851  MATMKEEFGRIKETLEKSEARRKELEEKMVSLLQEKNDLQLQVQAEQDNL   900

901  NDAEERCDQLIKNKIQLEAKVKEMNERLEDEEEMNAELTAKKRKLEDECS   950
      ||||||||||||||||||||||||||||||||||||||||||||||||||
 901  NDAEERCDQLIKNKIQLEAKVKEMNERLEDEEEMNAELTAKKRKLEDECS   950

951  ELKKDIDDLELTLAKVEKEKHATENKVKNLTEEMAGLDEIIAKLTKEKKA   1000
      ||||||||||||||||||||||||||||||||||||||||||||||||||
 951  ELKKDIDDLELTLAKVEKEKHATENKVKNLTEEMAGLDEIIAKLTKEKKA   1000

1001  LQEAHQQALDDLQVEEDKVNSLSKSKVKLEQQVDDLEGSLEQEKKVRMDL   1050
      ||||||||||||||||||||||||||||||||||||||||||||||||||
1001  LQEAHQQALDDLQVEEDKVNSLSKSKVKLEQQVDDLEGSLEQEKKVRMDL   1050

1051  ERAKRKLEGDLKLTQESIMDLENDKLQLEEKLKKKEFDINQQNSKIEDEQ   1100
      ||||||||||||||||||||||||||||||||||||||||||||||||||
1051  ERAKRKLEGDLKLTQESIMDLENDKLQLEEKLKKKEFDINQQNSKIEDEQ   1100

1101  ALALQLQKKLKENQARIEELEEELEAERTARAKVEKLRSDLSRELEEISE   1150
      ||||||||||||||||||||||||||||||||||||||||||||||||||
1101  ALALQLQKKLKENQARIEELEEELEAERTARAKVEKLRSDLSRELEEISE   1150

1151  RLEEAGGATSVQIEMNKKREAEFQKMRRDLEEATLQHEATAAALRKKHAD   1200
      ||||||||||||||||||||||||||||||||||||||||||||||||||
1151  RLEEAGGATSVQIEMNKKREAEFQKMRRDLEEATLQHEATAAALRKKHAD   1200

1201  SVAELGEQIDNLQRVKQKLEKEKSEFKLELDDVTSNMEQIIKAKANLEKV   1250
      ||||||||||||||||||||||||||||||||||||||||||||||||||
1201  SVAELGEQIDNLQRVKQKLEKEKSEFKLELDDVTSNMEQIIKAKANLEKV   1250

1251  SRTLEDQANEYRVKLEEAQRSLNDFTTQRAKLQTENGELARQLEEKEALI   1300
      ||||||||||||||||||||||||||||||||||||||||||||||||||
1251  SRTLEDQANEYRVKLEEAQRSLNDFTTQRAKLQTENGELARQLEEKEALI   1300

1301  SQLTRGKLSYTQQMEDLKRQLEEEGKVR   1328
      ||||||||||||||||||||||| :
1301  SQLTRGKLSYTQQMEDLKRQLEEEGKAK   1328
```

Sequence name: MYH6_HUMAN_V2 (SEQ ID NO:339)

Sequence documentation:

Alignment of: HSACMHCP_PEA_1_P4 (SEQ ID NO:328)×MYH6—HUMAN_V2 (SEQ ID NO:339)

Alignment segment 1/1:

| Quality: | 14661.00 | Escore: | 0 |
|---|---|---|---|
| Matching length: | 1508 | Total length: | 1508 |
| Matching Percent | 100.00 | Matching Percent | 100.00 |

-continued

Alignment segment 1/1:

| Similarity: | | Identity: | |
|---|---|---|---|
| Total Percent Similarity: | 100.00 | Total Percent Identity: | 100.00 |
| Gaps: | 0 | | |

Alignment:

```
   1  MTDAQMADFGAAAQYLRKSEKERLEAQTRPFDIRTECFVPDDKEEFVKAK    50
      ||||||||||||||||||||||||||||||||||||||||||||||||||
   1  MTDAQMADFGAAAQYLRKSEKERLEAQTRPFDIRTECFVPDDKEEFVKAK    50

51  ILSREGGKVIAETENGKTVTVKEDQVLQQNPPKFDKIEDMAMLTFLHEPA   100
      ||||||||||||||||||||||||||||||||||||||||||||||||||
  51  ILSREGGKVIAETENGKTVTVKEDQVLQQNPPKFDKIEDMAMLTFLHEPA   100

101  VLFNLKERYAAWMIYTYSGLFCVTVNPYKWLPVYNAEVVAAYRGKKRSEA   150
      ||||||||||||||||||||||||||||||||||||||||||||||||||
 101  VLFNLKERYAAWMIYTYSGLFCVTVNPYKWLPVYNAEVVAAYRGKKRSEA   150

151  PPHIFSISDNAYQYMLTDRENQSILITGESGAGKTVNTKRVIQYFASIAA   200
      ||||||||||||||||||||||||||||||||||||||||||||||||||
 151  PPHIFSISDNAYQYMLTDRENQSILITGESGAGKTVNTKRVIQYFASIAA   200
```

-continued

```
 201  IGDRGKKDNANANKGTLEDQIIQANPALEAFGNAKTVRNDNSSRFGKFIR  250
      ||||||||||||||||||||||||||||||||||||||||||||||||||
 201  IGDRGKKDNANANKGTLEDQIIQANPALEAFGNAKTVRNDNSSRFGKFIR  250

251  IHFGATGKLASADIETYLLEKSRVIFQLKAERNYHIFYQILSNKKPELLD  300
      ||||||||||||||||||||||||||||||||||||||||||||||||||
 251  IHFGATGKLASADIETYLLEKSRVIFQLKAERNYHIFYQILSNKKPELLD  300

301  MLLVTNNPYDYAFVSQGEVSVASIDDSEELMATDSAFDVLGFTSEEKAGV  350
      ||||||||||||||||||||||||||||||||||||||||||||||||||
 301  MLLVTNNPYDYAFVSQGEVSVASIDDSEELMATDSAFDVLGFTSEEKAGV  350

351  YKLTGAIMHYGNMKFKQKQREEQAEPDGTEDADKSAYLMGLNSADLLKGL  400
      ||||||||||||||||||||||||||||||||||||||||||||||||||
 351  YKLTGAIMHYGNMKFKQKQREEQAEPDGTEDADKSAYLMGLNSADLLKGL  400

401  CHPRVKVGNEYVTKGQSVQQVYYSIGALAKAVYEKMFNWMVTRINATLET  450
      ||||||||||||||||||||||||||||||||||||||||||||||||||
 401  CHPRVKVGNEYVTKGQSVQQVYYSIGALAKAVYEKMFNWMVTRINATLET  450

451  KQPRQYFIGVLDIAGFEIFDFNSFEQLCINFTNEKLQQFFNHHMFVLEQE  500
      ||||||||||||||||||||||||||||||||||||||||||||||||||
 451  KQPRQYFIGVLDIAGFEIFDFNSFEQLCINFTNEKLQQFFNHHMFVLEQE  500

501  EYKKEGIEWTFIDFGMDLQACIDLIEKPMGIMSILEEECMFPKATDMTFK  550
      ||||||||||||||||||||||||||||||||||||||||||||||||||
 501  EYKKEGIEWTFIDFGMDLQACIDLIEKPMGIMSILEEECMFPKATDMTFK  550

551  AKLYDNHLGKSNNFQKPRNIKGKQEAHFSLIHYAGTVDYNILGWLEKNKD  600
      ||||||||||||||||||||||||||||||||||||||||||||||||||
 551  AKLYDNHLGKSNNFQKPRNIKGKQEAHFSLIHYAGTVDYNILGWLEKNKD  600

601  PLNETVVALYQKSSLKLMATLFSSYATADTGDSGKSKGGKKKGSSFQTVS  650
      ||||||||||||||||||||||||||||||||||||||||||||||||||
 601  PLNETVVALYQKSSLKLMATLFSSYATADTGDSGKSKGGKKKGSSFQTVS  650

651  ALHRENLNKLMTNLRTTHPHFVRCIIPNERKAPGVMDNPLVMHQLRCNGV  700
      ||||||||||||||||||||||||||||||||||||||||||||||||||
 651  ALHRENLNKLMTNLRTTHPHFVRCIIPNERKAPGVMDNPLVMHQLRCNGV  700

701  LEGIRICRKGFPNRILYGDFRQRYRILNPVAIPEGQFIDSRKGTEKLLSS  750
      ||||||||||||||||||||||||||||||||||||||||||||||||||
 701  LEGIRICRKGFPNRILYGDFRQRYRILNPVAIPEGQFIDSRKGTEKLLSS  750

751  LDIDHNQYKFGHTKVFFKAGLLGLLEEMRDERLSRIITRMQAQARGQLMR  800
      ||||||||||||||||||||||||||||||||||||||||||||||||||
 751  LDIDHNQYKFGHTKVFFKAGLLGLLEEMRDERLSRIITRMQAQARGQLMR  800

801  IEFKKIVERRDALLVIQWNIRAFMGVKNWPWMKLYFKIKPLLKSAETEKE  850
      ||||||||||||||||||||||||||||||||||||||||||||||||||
 801  IEFKKIVERRDALLVIQWNIRAFMGVKNWPWMKLYFKIKPLLKSAETEKE  850

851  MATMKEEFGRIKETLEKSEARRKELEEKMVSLLQEKNDLQLQVQAEQDNL  900
      ||||||||||||||||||||||||||||||||||||||||||||||||||
 851  MATMKEEFGRIKETLEKSEARRKELEEKMVSLLQEKNDLQLQVQAEQDNL  900

901  NDAEERCDQLIKNKIQLEAKVKEMNERLEDEEEMNAELTAKKRKLEDECS  950
      ||||||||||||||||||||||||||||||||||||||||||||||||||
 901  NDAEERCDQLIKNKIQLEAKVKEMNERLEDEEEMNAELTAKKRKLEDECS  950

951  ELKKDIDDLELTLAKVEKEKHATENKVKNLTEEMAGLDEIIAKLTKEKKA 1000
      ||||||||||||||||||||||||||||||||||||||||||||||||||
 951  ELKKDIDDLELTLAKVEKEKHATENKVKNLTEEMAGLDEIIAKLTKEKKA 1000

1001  LQEAHQQALDDLQVEEDKVNSLSKSKVKLEQQVDDLEGSLEQEKKVRMDL 1050
      ||||||||||||||||||||||||||||||||||||||||||||||||||
1001  LQEAHQQALDDLQVEEDKVNSLSKSKVKLEQQVDDLEGSLEQEKKVRMDL 1050

1051  ERAKRKLEGDLKLTQESIMDLENDKLQLEEKLKKKEFDINQQNSKIEDEQ 1100
      ||||||||||||||||||||||||||||||||||||||||||||||||||
1051  ERAKRKLEGDLKLTQESIMDLENDKLQLEEKLKKKEFDINQQNSKIEDEQ 1100

1101  ALALQLQKKLKENQARIEELEEELEAERTARAKVEKLRSDLSRELEEISE 1150
      ||||||||||||||||||||||||||||||||||||||||||||||||||
1101  ALALQLQKKLKENQARIEELEEELEAERTARAKVEKLRSDLSRELEEISE 1150

1151  RLEEAGGATSVQIEMNKKREAEFQKMRRDLEEATLQHEATAAALRKKHAD 1200
      ||||||||||||||||||||||||||||||||||||||||||||||||||
1151  RLEEAGGATSVQIEMNKKREAEFQKMRRDLEEATLQHEATAAALRKKHAD 1200
```

```
1201  SVAELGEQIDNLQRVKQKLEKEKSEFKLELDDVTSNMEQIIKAKANLEKV  1250
      ||||||||||||||||||||||||||||||||||||||||||||||||||
1201  SVAELGEQIDNLQRVKQKLEKEKSEFKLELDDVTSNMEQIIKAKANLEKV  1250

1251  SRTLEDQANEYRVKLEEAQRSLNDFTTQRAKLQTENGELARQLEEKEALI  1300
      ||||||||||||||||||||||||||||||||||||||||||||||||||
1251  SRTLEDQANEYRVKLEEAQRSLNDFTTQRAKLQTENGELARQLEEKEALI  1300

1301  SQLTRGKLSYTQQMEDLKRQLEEEGKAKNALAHALQSARHDCDLLREQYE  1350
      ||||||||||||||||||||||||||||||||||||||||||||||||||
1301  SQLTRGKLSYTQQMEDLKRQLEEEGKAKNALAHALQSARHDCDLLREQYE  1350

1351  EETEAKAELQRVLSKANSEVAQWRTKYETDAIQRTEELEEAKKKLAQRLQ  1400
      ||||||||||||||||||||||||||||||||||||||||||||||||||
1351  EETEAKAELQRVLSKANSEVAQWRTKYETDAIQRTEELEEAKKKLAQRLQ  1400

1401  DAEEAVEAVNAKCSSLEKTKHRLQNEIEDLMVDVERSNAAAAALDKKQRN  1450
      ||||||||||||||||||||||||||||||||||||||||||||||||||
1401  DAEEAVEAVNAKCSSLEKTKHRLQNEIEDLMVDVERSNAAAAALDKKQRN  1450

1451  FDKILAEWKQKYEESQSELESSQKEARSLSTELFKLKNAYEESLEHLETF  1500
      ||||||||||||||||||||||||||||||||||||||||||||||||||
1451  FDKILAEWKQKYEESQSELESSQKEARSLSTELFKLKNAYEESLEHLETF  1500

1501  KRENKNLQ  1508
      ||||||||
1501  KRENKNLQ  1508
```

Sequence name: MYH6_HUMAN_V1 (SEQ ID NO:338)

Sequence documentation:

Alignment of: HSACMHCP_PEA_1_P6 (SEQ ID NO:329)×MYH6_HUMAN_V1 (SEQ ID NO:338)

| Alignment segment 1/1: | | | |
|---|---|---|---|
| Quality: | 17088.00 | Escore: | 0 |
| Matching length: | 1763 | Total length: | 1763 |
| Matching Percent | 100.00 | Matching Percent | 100.00 |

| Alignment segment 1/1: | | | |
|---|---|---|---|
| Similarity: | | Identity: | |
| Total Percent Similarity: | 100.00 | Total Percent Identity: | 100.00 |
| Gaps: | 0 | | |

Alignment:

```
  1  MTDAQMADFGAAAQYLRKSEKERLEAQTRPFDIRTECFVPDDKEEFVKAK   50
     ||||||||||||||||||||||||||||||||||||||||||||||||||
  1  MTDAQMADFGAAAQYLRKSEKERLEAQTRPFDIRTECFVPDDKEEFVKAK   50

51  ILSREGGKVIAETENGKTVTVKEDQVLQQNPPKFDKIEDMAMLTFLHEPA  100
     ||||||||||||||||||||||||||||||||||||||||||||||||||
 51  ILSREGGKVIAETENGKTVTVKEDQVLQQNPPKFDKIEDMAMLTFLHEPA  100

101  VLFNLKERYAAWMIYTYSGLFCVTVNPYKWLPVYNAEVVAAYRGKKRSEA  150
     ||||||||||||||||||||||||||||||||||||||||||||||||||
101  VLFNLKERYAAWMIYTYSGLFCVTVNPYKWLPVYNAEVVAAYRGKKRSEA  150

151  PPHIFSISDNAYQYMLTDRENQSILITGESGAGKTVNTKRVIQYFASIAA  200
     ||||||||||||||||||||||||||||||||||||||||||||||||||
151  PPHIFSISDNAYQYMLTDRENQSILITGESGAGKTVNTKRVIQYFASIAA  200

201  IGDRGKKDNANANKGTLEDQIIQANPALEAFGNAKTVRNDNSSRFGKFIR  250
     ||||||||||||||||||||||||||||||||||||||||||||||||||
201  IGDRGKKDNANANKGTLEDQIIQANPALEAFGNAKTVRNDNSSRFGKFIR  250

251  IHFGATGKLASADIETYLLEKSRVIFQLKAERNYHIFYQILSNKKPELLD  300
     ||||||||||||||||||||||||||||||||||||||||||||||||||
251  IHFGATGKLASADIETYLLEKSRVIFQLKAERNYHIFYQILSNKKPELLD  300

301  MLLVTNNPYDYAFVSQGEVSVASIDDSEELMATDSAFDVLGFTSEEKAGV  350
     ||||||||||||||||||||||||||||||||||||||||||||||||||
301  MLLVTNNPYDYAFVSQGEVSVASIDDSEELMATDSAFDVLGFTSEEKAGV  350

351  YKLTGAIMHYGNMKFKQKQREEQAEPDGTEDADKSAYLMGLNSADLLKGL  400
     ||||||||||||||||||||||||||||||||||||||||||||||||||
351  YKLTGAIMHYGNMKFKQKQREEQAEPDGTEDADKSAYLMGLNSADLLKGL  400
```

-continued

```
401  CHPRVKVGNEYVTKGQSVQQVYYSIGALAKAVYEKMFNWMVTRINATLET  450
     ||||||||||||||||||||||||||||||||||||||||||||||||||
401  CHPRVKVGNEYVTKGQSVQQVYYSIGALAKAVYEKMFNWMVTRINATLET  450

451  KQPRQYFIGVLDIAGFEIFDFNSFEQLCINFTNEKLQQFFNHHMFVLEQE  500
     ||||||||||||||||||||||||||||||||||||||||||||||||||
451  KQPRQYFIGVLDIAGFEIFDFNSFEQLCINFTNEKLQQFFNHHMFVLEQE  500

501  EYKKEGIEWTFIDFGMDLQACIDLIEKPMGIMSILEEECMFPKATDMTFK  550
     ||||||||||||||||||||||||||||||||||||||||||||||||||
501  EYKKEGIEWTFIDFGMDLQACIDLIEKPMGIMSILEEECMFPKATDMTFK  550

551  AKLYDNHLGKSNNFQKPRNIKGKQEAHFSLIHYAGTVDYNILGWLEKNKD  600
     ||||||||||||||||||||||||||||||||||||||||||||||||||
551  AKLYDNHLGKSNNFQKPRNIKGKQEAHFSLIHYAGTVDYNILGWLEKNKD  600

601  PLNETVVALYQKSSLKLMATLFSSYATADTGDSGKSKGGKKKGSSFQTVS  650
     ||||||||||||||||||||||||||||||||||||||||||||||||||
601  PLNETVVALYQKSSLKLMATLFSSYATADTGDSGKSKGGKKKGSSFQTVS  650

651  ALHRENLNKLMTNLRTTHPHFVRCIIPNERKAPGVMDNPLVMHQLRCNGV  700
     ||||||||||||||||||||||||||||||||||||||||||||||||||
651  ALHRENLNKLMTNLRTTHPHFVRCIIPNERKAPGVMDNPLVMHQLRCNGV  700

701  LEGIRICRKGFPNRILYGDFRQRYRILNPVAIPEGQFIDSRKGTEKLLSS  750
     ||||||||||||||||||||||||||||||||||||||||||||||||||
701  LEGIRICRKGFPNRILYGDFRQRYRILNPVAIPEGQFIDSRKGTEKLLSS  750

751  LDIDHNQYKFGHTKVFFKAGLLGLLEEMRDERLSRIITRMQAQARGQLMR  800
     ||||||||||||||||||||||||||||||||||||||||||||||||||
751  LDIDHNQYKFGHTKVFFKAGLLGLLEEMRDERLSRIITRMQAQARGQLMR  800

801  IEFKKIVERRDALLVIQWNIRAFMGVKNWPWMKLYFKIKPLLKSAETEKE  850
     ||||||||||||||||||||||||||||||||||||||||||||||||||
801  IEFKKIVERRDALLVIQWNIRAFMGVKNWPWMKLYFKIKPLLKSAETEKE  850

851  MATMKEEFGRIKETLEKSEARRKELEEKMVSLLQEKNDLQLQVQAEQDNL  900
     ||||||||||||||||||||||||||||||||||||||||||||||||||
851  MATMKEEFGRIKETLEKSEARRKELEEKMVSLLQEKNDLQLQVQAEQDNL  900

901  NDAEERCDQLIKNKIQLEAKVKEMNERLEDEEEMNAELTAKKRKLEDECS  950
     ||||||||||||||||||||||||||||||||||||||||||||||||||
901  NDAEERCDQLIKNKIQLEAKVKEMNERLEDEEEMNAELTAKKRKLEDECS  950

951  ELKKDIDDLELTLAKVEKEKHATENKVKNLTEEMAGLDEIIAKLTKEKKA  1000
     ||||||||||||||||||||||||||||||||||||||||||||||||||
951  ELKKDIDDLELTLAKVEKEKHATENKVKNLTEEMAGLDEIIAKLTKEKKA  1000

1001 LQEAHQQALDDLQVEEDKVNSLSKSKVKLEQQVDDLEGSLEQEKKVRMDL  1050
     ||||||||||||||||||||||||||||||||||||||||||||||||||
1001 LQEAHQQALDDLQVEEDKVNSLSKSKVKLEQQVDDLEGSLEQEKKVRMDL  1050

1051 ERAKRKLEGDLKLTQESIMDLENDKLQLEEKLKKKEFDINQQNSKIEDEQ  1100
     ||||||||||||||||||||||||||||||||||||||||||||||||||
1051 ERAKRKLEGDLKLTQESIMDLENDKLQLEEKLKKKEFDINQQNSKIEDEQ  1100

1101 ALALQLQKKLKENQARIEELEEELEAERTARAKVEKLRSDLSRELEEISE  1150
     ||||||||||||||||||||||||||||||||||||||||||||||||||
1101 ALALQLQKKLKENQARIEELEEELEAERTARAKVEKLRSDLSRELEEISE  1150

1151 RLEEAGGATSVQIEMNKKREAEFQKMRRDLEEATLQHEATAAALRKKHAD  1200
     ||||||||||||||||||||||||||||||||||||||||||||||||||
1151 RLEEAGGATSVQIEMNKKREAEFQKMRRDLEEATLQHEATAAALRKKHAD  1200

1201 SVAELGEQIDNLQRVKQKLEKEKSEFKLELDDVTSNMEQIIKAKANLEKV  1250
     ||||||||||||||||||||||||||||||||||||||||||||||||||
1201 SVAELGEQIDNLQRVKQKLEKEKSEFKLELDDVTSNMEQIIKAKANLEKV  1250

1251 SRTLEDQANEYRVKLEEAQRSLNDFTTQRAKLQTENGELARQLEEKEALI  1300
     ||||||||||||||||||||||||||||||||||||||||||||||||||
1251 SRTLEDQANEYRVKLEEAQRSLNDFTTQRAKLQTENGELARQLEEKEALI  1300

1301 SQLTRGKLSYTQQMEDLKRQLEEEGKAKNALAHALQSARHDCDLLREQYE  1350
     ||||||||||||||||||||||||||||||||||||||||||||||||||
1301 SQLTRGKLSYTQQMEDLKRQLEEEGKAKNALAHALQSARHDCDLLREQYE  1350

1351 EETEAKAELQRVLSKANSEVAQWRTKYETDAIQRTEELEEAKKKLAQRLQ  1400
     ||||||||||||||||||||||||||||||||||||||||||||||||||
1351 EETEAKAELQRVLSKANSEVAQWRTKYETDAIQRTEELEEAKKKLAQRLQ  1400
```

```
1401  DAEEAVEAVNAKCSSLEKTKHRLQNEIEDLMVDVERSNAAAAALDKKQRN  1450
      ||||||||||||||||||||||||||||||||||||||||||||||||||
1401  DAEEAVEAVNAKCSSLEKTKHRLQNEIEDLMVDVERSNAAAAALDKKQRN  1450

1451  FDKILAEWKQKYEESQSELESSQKEARSLSTELFKLKNAYEESLEHLETF  1500
      ||||||||||||||||||||||||||||||||||||||||||||||||||
1451  FDKILAEWKQKYEESQSELESSQKEARSLSTELFKLKNAYEESLEHLETF  1500

1501  KRENKNLQEEISDLTEQLGEGGKNVHELEKVRKQLEVEKLELQSALEEEA  1550
      ||||||||||||||||||||||||||||||||||||||||||||||||||
1501  KRENKNLQEEISDLTEQLGEGGKNVHELEKVRKQLEVEKLELQSALEEEA  1550

1551  ASLEHEEGKILRAQLEFNQIKAEIERKLAEKDEEMEQAKRNHQRVVDSLQ  1600
      ||||||||||||||||||||||||||||||||||||||||||||||||||
1551  ASLEHEEGKILRAQLEFNQIKAEIERKLAEKDEEMEQAKRNHQRVVDSLQ  1600

1601  TSLDAETRSRNEVLRVKKKMEGDLNEMEIQLSHANRMAAEAQKQVKSLQS  1650
      ||||||||||||||||||||||||||||||||||||||||||||||||||
1601  TSLDAETRSRNEVLRVKKKMEGDLNEMEIQLSHANRMAAEAQKQVKSLQS  1650

1651  LLKDTQIQLDDAVRANDDLKENIAIVERRNNLLQAELEELRAVVEQTERS  1700
      ||||||||||||||||||||||||||||||||||||||||||||||||||
1651  LLKDTQIQLDDAVRANDDLKENIAIVERRNNLLQAELEELRAVVEQTERS  1700

1701  RKLAEQELIETSERVQLLHSQNTSLINQKKKMESDLTQLQSEVEEAVQEC  1750
      ||||||||||||||||||||||||||||||||||||||||||||||||||
1701  RKLAEQELIETSERVQLLHSQNTSLINQKKKMESDLTQLQSEVEEAVQEC  1750

1751  RNAEEKAKKAITD                                      1763
      |||||||||||||
1751  RNAEEKAKKAITD                                      1763
```

Sequence name: MYH6_HUMAN_V3 (SEQ ID NO:340)

Sequence documentation:

Alignment of: HSACMHCP_PEA_1_P12 (SEQ ID NO:330) × MYH6_HUMAN_V3 (SEQ ID NO:340)

Alignment segment 1/1:

| | | | |
|---|---|---|---|
| Quality: | 13633.00 | Escore: | 0 |
| Matching length: | 1413 | Total length: | 1413 |
| Matching Percent | 100.00 | Matching Percent | 99.93 |

Alignment segment 1/1:

| | | | |
|---|---|---|---|
| Similarity: | | Identity: | |
| Total Percent Similarity: | 100.00 | Total Percent Identity: | 99.93 |
| Gaps: | 0 | | |

Alignment:

```
 22  QPMGIMSILEEECMFPKATDMTFKAKLYDNHLGKSNNFQKPRNIKGKQEA   71
     :|||||||||||||||||||||||||||||||||||||||||||||||||
527  KPMGIMSILEEECMFPKATDMTFKAKLYDNHLGKSNNFQKPRNIKGKQEA  576

72  HFSLIHYAGTVDYNILGWLEKNKDPLNETVVALYQKSSLKLMATLFSSYA  121
     |||||||||||||||||||||||||||||||||||||||||||||||||
577  HFSLIHYAGTVDYNILGWLEKNKDPLNETVVALYQKSSLKLMATLFSSYA  626

122  TADTGDSGKSKGGKKKGSSFQTVSALHRENLNKLMTNLRTTHPHFVRCII  171
     |||||||||||||||||||||||||||||||||||||||||||||||||
627  TADTGDSGKSKGGKKKGSSFQTVSALHRENLNKLMTNLRTTHPHFVRCII  676

172  PNERKAPGVMDNPLVMHQLRCNGVLEGIRICRKGFPNRILYGDFRQRYRI  221
     |||||||||||||||||||||||||||||||||||||||||||||||||
677  PNERKAPGVMDNPLVMHQLRCNGVLEGIRICRKGFPNRILYGDFRQRYRI  726

222  LNPVAIPEGQFIDSRKGTEKLLSSLDIDHNQYKFGHTKVFFKAGLLGLLE  271
     |||||||||||||||||||||||||||||||||||||||||||||||||
727  LNPVAIPEGQFIDSRKGTEKLLSSLDIDHNQYKFGHTKVFFKAGLLGLLE  776

272  EMRDERLSRIITRMQAQARGQLMRIEFKKIVERRDALLVIQWNIRAFMGV  321
     |||||||||||||||||||||||||||||||||||||||||||||||||
777  EMRDERLSRIITRMQAQARGQLMRIEFKKIVERRDALLVIQWNIRAFMGV  826

322  KNWPWMKLYFKIKPLLKSAETEKEMATMKEEFGRIKETLEKSEARRKELE  371
     |||||||||||||||||||||||||||||||||||||||||||||||||
827  KNWPWMKLYFKIKPLLKSAETEKEMATMKEEFGRIKETLEKSEARRKELE  876
```

```
 372  EKMVSLLQEKNDLQLQVQAEQDNLNDAEERCDQLIKNKIQLEAKVKEMNE   421
      ||||||||||||||||||||||||||||||||||||||||||||||||||
 877  EKMVSLLQEKNDLQLQVQAEQDNLNDAEERCDQLIKNKIQLEAKVKEMNE   926

422  RLEDEEEMNAELTAKKRKLEDECSELKKDIDDLELTLAKVEKEKHATENK   471
      |||||||||||||||||||||||||||||||||||||||||||||||||
 927  RLEDEEEMNAELTAKKRKLEDECSELKKDIDDLELTLAKVEKEKHATENK   976

472  VKNLTEEMAGLDEIIAKLTKEKKALQEAHQQALDDLQVEEDKVNSLSKSK   521
      |||||||||||||||||||||||||||||||||||||||||||||||||
 977  VKNLTEEMAGLDEIIAKLTKEKKALQEAHQQALDDLQVEEDKVNSLSKSK   1026

522  VKLEQQVDDLEGSLEQEKKVRMDLERAKRKLEGDLKLTQESIMDLENDKL   571
      |||||||||||||||||||||||||||||||||||||||||||||||||
1027  VKLEQQVDDLEGSLEQEKKVRMDLERAKRKLEGDLKLTQESIMDLENDKL   1076

572  QLEEKLKKKEFDINQQNSKIEDEQALALQLQKKLKENQARIEELEEELEA   621
      |||||||||||||||||||||||||||||||||||||||||||||||||
1077  QLEEKLKKKEFDINQQNSKIEDEQALALQLQKKLKENQARIEELEEELEA   1126

622  ERTARAKVEKLRSDLSRELEEISERLEEAGGATSVQIEMNKKREAEFQKM   671
      |||||||||||||||||||||||||||||||||||||||||||||||||
1127  ERTARAKVEKLRSDLSRELEEISERLEEAGGATSVQIEMNKKREAEFQKM   1176

672  RRDLEEATLQHEATAAALRKKHADSVAELGEQIDNLQRVKQKLEKEKSEF   721
      |||||||||||||||||||||||||||||||||||||||||||||||||
1177  RRDLEEATLQHEATAAALRKKHADSVAELGEQIDNLQRVKQKLEKEKSEF   1226

722  KLELDDVTSNMEQIIKAKANLEKVSRTLEDQANEYRVKLEEAQRSLNDFT   771
      |||||||||||||||||||||||||||||||||||||||||||||||||
1227  KLELDDVTSNMEQIIKAKANLEKVSRTLEDQANEYRVKLEEAQRSLNDFT   1276

772  TQRAKLQTENGELARQLEEKEALISQLTRGKLSYTQQMEDLKRQLEEEGK   821
      |||||||||||||||||||||||||||||||||||||||||||||||||
1277  TQRAKLQTENGELARQLEEKEALISQLTRGKLSYTQQMEDLKRQLEEEGK   1326

822  AKNALAHALQSARHDCDLLREQYEEETEAKAELQRVLSKANSEVAQWRTK   871
      |||||||||||||||||||||||||||||||||||||||||||||||||
1327  AKNALAHALQSARHDCDLLREQYEEETEAKAELQRVLSKANSEVAQWRTK   1376

872  YETDAIQRTEELEEAKKKLAQRLQDAEEAVEAVNAKCSSLEKTKHRLQNE   921
      |||||||||||||||||||||||||||||||||||||||||||||||||
1377  YETDAIQRTEELEEAKKKLAQRLQDAEEAVEAVNAKCSSLEKTKHRLQNE   1426

922  IEDLMVDVERSNAAAAALDKKQRNFDKILAEWKQKYEESQSELESSQKEA   971
      |||||||||||||||||||||||||||||||||||||||||||||||||
1427  IEDLMVDVERSNAAAAALDKKQRNFDKILAEWKQKYEESQSELESSQKEA   1476

972  RSLSTELFKLKNAYEESLEHLETFKRENKNLQEEISDLTEQLGEGGKNVH   1021
      |||||||||||||||||||||||||||||||||||||||||||||||||
1477  RSLSTELFKLKNAYEESLEHLETFKRENKNLQEEISDLTEQLGEGGKNVH   1526

1022  ELEKVRKQLEVEKLELQSALEEAEASLEHEEGKILRAQLEFNQIKAEIER   1071
      |||||||||||||||||||||||||||||||||||||||||||||||||
1527  ELEKVRKQLEVEKLELQSALEEAEASLEHEEGKILRAQLEFNQIKAEIER   1576

1072  KLAEKDEEMEQAKRNHQRVVDSLQTSLDAETRSRNEVLRVKKKMEGDLNE   1121
      |||||||||||||||||||||||||||||||||||||||||||||||||
1577  KLAEKDEEMEQAKRNHQRVVDSLQTSLDAETRSRNEVLRVKKKMEGDLNE   1626

1122  MEIQLSHANRMAAEAQKQVKSLQSLLKDTQIQLDDAVRANDDLKENIAIV   1171
      |||||||||||||||||||||||||||||||||||||||||||||||||
1627  MEIQLSHANRMAAEAQKQVKSLQSLLKDTQIQLDDAVRANDDLKENIAIV   1676

1172  ERRNNLLQAELEELRAVVEQTERSRKLAEQELIETSERVQLLHSQNTSLI   1221
      |||||||||||||||||||||||||||||||||||||||||||||||||
1677  ERRNNLLQAELEELRAVVEQTERSRKLAEQELIETSERVQLLHSQNTSLI   1726

1222  NQKKKMESDLTQLQSEVEEAVQECRNAEEKAKKAITDAAMMAEELKKEQD   1271
      |||||||||||||||||||||||||||||||||||||||||||||||||
1727  NQKKKMESDLTQLQSEVEEAVQECRNAEEKAKKAITDAAMMAEELKKEQD   1776

1272  TSAHLERMKKNMEQTIKDLQHRLDEAEQIALKGGKKQLQKLEARVRELEG   1321
      |||||||||||||||||||||||||||||||||||||||||||||||||
1777  TSAHLERMKKNMEQTIKDLQHRLDEAEQIALKGGKKQLQKLEARVRELEG   1826

1322  ELEAEQKRNAESVKGMRKSERRIKELTYQTEEDKKNLLRLQDLVDKLQLK   1371
      |||||||||||||||||||||||||||||||||||||||||||||||||
1827  ELEAEQKRNAESVKGMRKSERRIKELTYQTEEDKKNLLRLQDLVDKLQLK   1876
```

-continued

```
1372  VKAYKRQAEEAEEQANTNLSKFRKVQHELDEAEERADIAESQVNKLRAKS  1421
      ||||||||||||||||||||||||||||||||||||||||||||||||||
1877  VKAYKRQAEEAEEQANTNLSKFRKVQHELDEAEERADIAESQVNKLRAKS  1926

1422  RDIGAKQKMHDEE                                       1434
      |||||||||||||
1927  RDIGAKQKMHDEE                                       1939
```

Sequence name: MYH6_HUMAN_V2 (SEQ ID NO:339)
Sequence documentation:
Alignment of: HSACMHCP_PEA_1_P16 (SEQ ID NO:331)×MYH6_HUMAN_V2 (SEQ ID NO:339)

| Alignment segment 1/1: | | | |
|---|---|---|---|
| Quality: | 5155.00 | Escore: | 0 |
| Matching length: | 527 | Total length: | 527 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Sequence name: MYH6_HUMAN_V1 (SEQ ID NO:338)
Sequence documentation:
Alignment of: HSACMHCP_PEA_1_P25 (SEQ ID NO:332)×MYH6_HUMAN_V1 (SEQ ID NO:338)

| Alignment segment 1/1: | | | |
|---|---|---|---|
| Quality: | 17293.00 | Escore: | 0 |
| Matching length: | 1798 | Total length: | 1855 |
| Matching Percent Similarity: | 100.00 | Matching Percent Identity: | 100.00 |
| Total Percent Similarity: | 96.93 | Total Percent Identity: | 96.93 |
| Gaps: | 1 | | |

Alignment:

```
  1   MTDAQMADFGAAAQYLRKSEKERLEAQTRPFDIRTECFVPDDKEEFVKAK   50
      ||||||||||||||||||||||||||||||||||||||||||||||||||
  1   MTDAQMADFGAAAQYLRKSEKERLEAQTRPFDIRTECFVPDDKEEFVKAK   50

51   ILSREGGKVIAETENGKTVTVKEDQVLQQNPPKFDKIEDMAMLTFLHEPA  100
      ||||||||||||||||||||||||||||||||||||||||||||||||||
 51   ILSREGGKVIAETENGKTVTVKEDQVLQQNPPKFDKIEDMAMLTFLHEPA  100

101   VLFNLKERYAAWMIYTYSGLFCVTVNPYKWLPVYNAEVVAAYRGKKRSEA  150
      ||||||||||||||||||||||||||||||||||||||||||||||||||
101   VLFNLKERYAAWMIYTYSGLFCVTVNPYKWLPVYNAEVVAAYRGKKRSEA  150

151   PPHIFSISDNAYQYMLTDRENQSILITGESGAGKTVNTKRVIQYFASIAA  200
      ||||||||||||||||||||||||||||||||||||||||||||||||||
151   PPHIFSISDNAYQYMLTDRENQSILITGESGAGKTVNTKRVIQYFASIAA  200

201   IGDRGKKDNANANKGTLEDQIIQANPALEAFGNAKTVRNDNSSRFGKFIR  250
      ||||||||||||||||||||||||||||||||||||||||||||||||||
201   IGDRGKKDNANANKGTLEDQIIQANPALEAFGNAKTVRNDNSSRFGKFIR  250

251   IHFGATGKLASADIETYLLEKSRVIFQLKAERNYHIFYQILSNKKPELLD  300
      ||||||||||||||||||||||||||||||||||||||||||||||||||
251   IHFGATGKLASADIETYLLEKSRVIFQLKAERNYHIFYQILSNKKPELLD  300

301   MLLVTNNPYDYAFVSQGEVSVASIDDSEELMATDSAFDVLGFTSEEKAGV  350
      ||||||||||||||||||||||||||||||||||||||||||||||||||
301   MLLVTNNPYDYAFVSQGEVSVASIDDSEELMATDSAFDVLGFTSEEKAGV  350

351   YKLTGAIMHYGNMKFKQKQREEQAEPDGTEDADKSAYLMGLNSADLLKGL  400
      ||||||||||||||||||||||||||||||||||||||||||||||||||
351   YKLTGAIMHYGNMKFKQKQREEQAEPDGTEDADKSAYLMGLNSADLLKGL  400

401   CHPRVKVGNEYVTKGQSVQQVYYSIGALAKAVYEKMFNWMVTRINATLET  450
      ||||||||||||||||||||||||||||||||||||||||||||||||||
401   CHPRVKVGNEYVTKGQSVQQVYYSIGALAKAVYEKMFNWMVTRINATLET  450

451   KQPRQYFIGVLDIAGFEIFDFNSFEQLCINFTNEKLQQFFNHHMFVLEQE  500
      ||||||||||||||||||||||||||||||||||||||||||||||||||
451   KQPRQYFIGVLDIAGFEIFDFNSFEQLCINFTNEKLQQFFNHHMFVLEQE  500

501   EYKKEGIEWTFIDFGMDLQACIDLIEK                         527
      |||||||||||||||||||||||||||
501   EYKKEGIEWTFIDFGMDLQACIDLIEK                         527
```

Alignment:

```
  1 MTDAQMADFGAAAQYLRKSEKERLEAQTRPFDIRTECFVPDDKEEFVKAK   50
    ||||||||||||||||||||||||||||||||||||||||||||||||||
  1 MTDAQMADFGAAAQYLRKSEKERLEAQTRPFDIRTECFVPDDKEEFVKAK   50

51 ILSREGGKVIAETENGKTVTVKEDQVLQQNPPKFDKIEDMAMLTFLHEPA  100
    ||||||||||||||||||||||||||||||||||||||||||||||||||
 51 ILSREGGKVIAETENGKTVTVKEDQVLQQNPPKFDKIEDMAMLTFLHEPA  100

101 VLFNLKERYAAWMIYTYSGLFCVTVNPYKWLPVYNAEVVAAYRGKKRSEA  150
    ||||||||||||||||||||||||||||||||||||||||||||||||||
101 VLFNLKERYAAWMIYTYSGLFCVTVNPYKWLPVYNAEVVAAYRGKKRSEA  150

151 PPHIFSISDNAYQYMLTDRENQSILITGESGAGKTVNTKRVIQYFASIAA  200
    ||||||||||||||||||||||||||||||||||||||||||||||||||
151 PPHIFSISDNAYQYMLTDRENQSILITGESGAGKTVNTKRVIQYFASIAA  200

201 IGDRGKKDNANANKGTLEDQIIQANPALEAFGNAKTVRNDNSSRFGKFIR  250
    ||||||||||||||||||||||||||||||||||||||||||||||||||
201 IGDRGKKDNANANKGTLEDQIIQANPALEAFGNAKTVRNDNSSRFGKFIR  250

251 IHFGATGKLASADIETYLLEKSRVIFQLKAERNYHIFYQILSNKKPELLD  300
    ||||||||||||||||||||||||||||||||||||||||||||||||||
251 IHFGATGKLASADIETYLLEKSRVIFQLKAERNYHIFYQILSNKKPELLD  300

301 MLLVTNNPYDYAFVSQGEVSVASIDDSEELMATDSAFDVLGFTSEEKAGV  350
    ||||||||||||||||||||||||||||||||||||||||||||||||||
301 MLLVTNNPYDYAFVSQGEVSVASIDDSEELMATDSAFDVLGFTSEEKAGV  350

351 YKLTGAIMHYGNMKFKQKQREEQAEPDGTEDADKSAYLMGLNSADLLKGL  400
    ||||||||||||||||||||||||||||||||||||||||||||||||||
351 YKLTGAIMHYGNMKFKQKQREEQAEPDGTEDADKSAYLMGLNSADLLKGL  400

401 CHPRVKVGNEYVTKGQSVQQVYYSIGALAKAVYEKMFNWMVTRINATLET  450
    ||||||||||||||||||||||||||||||||||||||||||||||||||
401 CHPRVKVGNEYVTKGQSVQQVYYSIGALAKAVYEKMFNWMVTRINATLET  450

451 KQPRQYFIGVLDIAGFEIFD..............................  470
    ||||||||||||||||||||
451 KQPRQYFIGVLDIAGFEIFDFNSFEQLCINFTNEKLQQFFNHHMFVLEQE  500

471 ...........................PMGIMSILEEECMFPKATDMTFK  493
                               |||||||||||||||||||||||
501 EYKKEGIEWTFIDFGMDLQACIDLIEKPMGIMSILEEECMFPKATDMTFK  550

494 AKLYDNHLGKSNNFQKPRNIKGKQEAHFSLIHYAGTVDYNILGWLEKNKD  543
    ||||||||||||||||||||||||||||||||||||||||||||||||||
551 AKLYDNHLGKSNNFQKPRNIKGKQEAHFSLIHYAGTVDYNILGWLEKNKD  600

544 PLNETVVALYQKSSLKLMATLFSSYATADTGDSGKSKGGKKKGSSFQTVS  593
    ||||||||||||||||||||||||||||||||||||||||||||||||||
601 PLNETVVALYQKSSLKLMATLFSSYATADTGDSGKSKGGKKKGSSFQTVS  650

594 ALHRENLNKLMTNLRTTHPHFVRCIIPNERKAPGVMDNPLVMHQLRCNGV  643
    ||||||||||||||||||||||||||||||||||||||||||||||||||
651 ALHRENLNKLMTNLRTTHPHFVRCIIPNERKAPGVMDNPLVMHQLRCNGV  700

644 LEGIRICRKGFPNRILYGDFRQRYRILNPVAIPEGQFIDSRKGTEKLLSS  693
    ||||||||||||||||||||||||||||||||||||||||||||||||||
701 LEGIRICRKGFPNRILYGDFRQRYRILNPVAIPEGQFIDSRKGTEKLLSS  750

694 LDIDHNQYKFGHTKVFFKAGLLGLLEEMRDERLSRIITRMQAQARGQLMR  743
    ||||||||||||||||||||||||||||||||||||||||||||||||||
751 LDIDHNQYKFGHTKVFFKAGLLGLLEEMRDERLSRIITRMQAQARGQLMR  800

744 IEFKKIVERRDALLVIQWNIRAFMGVKNWPWMKLYFKIKPLLKSAETEKE  793
    ||||||||||||||||||||||||||||||||||||||||||||||||||
801 IEFKKIVERRDALLVIQWNIRAFMGVKNWPWMKLYFKIKPLLKSAETEKE  850

794 MATMKEEFGRIKETLEKSEARRKELEEKMVSLLQEKNDLQLQVQAEQDNL  843
    ||||||||||||||||||||||||||||||||||||||||||||||||||
851 MATMKEEFGRIKETLEKSEARRKELEEKMVSLLQEKNDLQLQVQAEQDNL  900

844 NDAEERCDQLIKNKIQLEAKVKEMNERLEDEEEMNAELTAKKRKLEDECS  893
    ||||||||||||||||||||||||||||||||||||||||||||||||||
901 NDAEERCDQLIKNKIQLEAKVKEMNERLEDEEEMNAELTAKKRKLEDECS  950
```

```
 894  ELKKDIDDLELTLAKVEKEKHATENKVKNLTEEMAGLDEIIAKLTKEKKA   943
      ||||||||||||||||||||||||||||||||||||||||||||||||||
 951  ELKKDIDDLELTLAKVEKEKHATENKVKNLTEEMAGLDEIIAKLTKEKKA  1000

944  LQEAHQQALDDLQVEEDKVNSLSKSKVKLEQQVDDLEGSLEQEKKVRMDL   993
      ||||||||||||||||||||||||||||||||||||||||||||||||||
1001  LQEAHQQALDDLQVEEDKVNSLSKSKVKLEQQVDDLEGSLEQEKKVRMDL  1050

994  ERAKRKLEGDLKLTQESIMDLENDKLQLEEKLKKKEFDINQQNSKIEDEQ  1043
      ||||||||||||||||||||||||||||||||||||||||||||||||||
1051  ERAKRKLEGDLKLTQESIMDLENDKLQLEEKLKKKEFDINQQNSKIEDEQ  1100

1044  ALALQLQKKLKENQARIEELEEELEAERTARAKVEKLRSDLSRELEEISE  1093
      ||||||||||||||||||||||||||||||||||||||||||||||||||
1101  ALALQLQKKLKENQARIEELEEELEAERTARAKVEKLRSDLSRELEEISE  1150

1094  RLEEAGGATSVQIEMNKKREAEFQKMRRDLEEATLQHEATAAALRKKHAD  1143
      ||||||||||||||||||||||||||||||||||||||||||||||||||
1151  RLEEAGGATSVQIEMNKKREAEFQKMRRDLEEATLQHEATAAALRKKHAD  1200

1144  SVAELGEQIDNLQRVKQKLEKEKSEFKLELDDVTSNMEQIIKAKANLEKV  1193
      ||||||||||||||||||||||||||||||||||||||||||||||||||
1201  SVAELGEQIDNLQRVKQKLEKEKSEFKLELDDVTSNMEQIIKAKANLEKV  1250

1194  SRTLEDQANEYRVKLEEAQRSLNDFTTQRAKLQTENGELARQLEEKEALI  1243
      ||||||||||||||||||||||||||||||||||||||||||||||||||
1251  SRTLEDQANEYRVKLEEAQRSLNDFTTQRAKLQTENGELARQLEEKEALI  1300

1244  SQLTRGKLSYTQQMEDLKRQLEEEGKAKNALAHALQSARHDCDLLREQYE  1293
      ||||||||||||||||||||||||||||||||||||||||||||||||||
1301  SQLTRGKLSYTQQMEDLKRQLEEEGKAKNALAHALQSARHDCDLLREQYE  1350

1294  EETEAKAELQRVLSKANSEVAQWRTKYETDAIQRTEELEEAKKKLAQRLQ  1343
      ||||||||||||||||||||||||||||||||||||||||||||||||||
1351  EETEAKAELQRVLSKANSEVAQWRTKYETDAIQRTEELEEAKKKLAQRLQ  1400

1344  DAEEAVEAVNAKCSSLEKTKHRLQNEIEDLMVDVERSNAAAAALDKKQRN  1393
      ||||||||||||||||||||||||||||||||||||||||||||||||||
1401  DAEEAVEAVNAKCSSLEKTKHRLQNEIEDLMVDVERSNAAAAALDKKQRN  1450

1394  FDKILAEWKQKYEESQSELESSQKEARSLSTELFKLKNAYEESLEHLETF  1443
      ||||||||||||||||||||||||||||||||||||||||||||||||||
1451  FDKILAEWKQKYEESQSELESSQKEARSLSTELFKLKNAYEESLEHLETF  1500

1444  KRENKNLQEEISDLTEQLGEGGKNVHELEKVRKQLEVEKLELQSALEEAE  1493
      ||||||||||||||||||||||||||||||||||||||||||||||||||
1501  KRENKNLQEEISDLTEQLGEGGKNVHELEKVRKQLEVEKLELQSALEEAE  1550

1494  ASLEHEEGKILRAQLEFNQIKAEIERKLAEKDEEMEQAKRNHQRVVDSLQ  1543
      ||||||||||||||||||||||||||||||||||||||||||||||||||
1551  ASLEHEEGKILRAQLEFNQIKAEIERKLAEKDEEMEQAKRNHQRVVDSLQ  1600

1544  TSLDAETRSRNEVLRVKKKMEGDLNEMEIQLSHANRMAAEAQKQVKSLQS  1593
      ||||||||||||||||||||||||||||||||||||||||||||||||||
1601  TSLDAETRSRNEVLRVKKKMEGDLNEMEIQLSHANRMAAEAQKQVKSLQS  1650

1594  LLKDTQIQLDDAVRANDDLKENIAIVERRNNLLQAELEELRAVVEQTERS  1643
      ||||||||||||||||||||||||||||||||||||||||||||||||||
1651  LLKDTQIQLDDAVRANDDLKENIAIVERRNNLLQAELEELRAVVEQTERS  1700

1644  RKLAEQELIETSERVQLLHSQNTSLINQKKKMESDLTQLQSEVEEAVQEC  1693
      ||||||||||||||||||||||||||||||||||||||||||||||||||
1701  RKLAEQELIETSERVQLLHSQNTSLINQKKKMESDLTQLQSEVEEAVQEC  1750

1694  RNAEEKAKKAITDAAMMAEELKKEQDTSAHLERMKKNMEQTIKDLQHRLD  1743
      ||||||||||||||||||||||||||||||||||||||||||||||||||
1751  RNAEEKAKKAITDAAMMAEELKKEQDTSAHLERMKKNMEQTIKDLQHRLD  1800

1744  EAEQIALKGGKKQLQKLEARVRELEGELEAEQKRNAESVKGMRKSERRIK  1793
      ||||||||||||||||||||||||||||||||||||||||||||||||||
1801  EAEQIALKGGKKQLQKLEARVRELEGELEAEQKRNAESVKGMRKSERRIK  1850

1794  ELTYQ  1798
      |||||
1851  ELTYQ  1855
```

Sequence name: MYH6_HUMAN_V3 (SEQ ID NO:340)

Sequence documentation:

Alignment of: HSACMHCP_PEA_1_P28 (SEQ ID NO:333)×MYH6_HUMAN_V3 (SEQ ID NO:340)

| Alignment segment 1/1: | | | |
|---|---|---|---|
| Quality: | 17163.00 | Escore: | 0 |
| Matching length: | 1775 | Total length: | 1775 |

| Alignment segment 1/1: | | | |
|---|---|---|---|
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MLTDRENQSILITGESGAGKTVNTKRVIQYFASIAAIGDRGKKDNANANK   50
    ||||||||||||||||||||||||||||||||||||||||||||||||||
165 MLTDRENQSILITGESGAGKTVNTKRVIQYFASIAAIGDRGKKDNANANK  214

51 GTLEDQIIQANPALEAFGNAKTVRNDNSSRFGKFIRIHFGATGKLASADI  100
    ||||||||||||||||||||||||||||||||||||||||||||||||||
215 GTLEDQIIQANPALEAFGNAKTVRNDNSSRFGKFIRIHFGATGKLASADI  264

101 ETYLLEKSRVIFQLKAERNYHIFYQILSNKKPELLDMLLVTNNPYDYAFV  150
    ||||||||||||||||||||||||||||||||||||||||||||||||||
265 ETYLLEKSRVIFQLKAERNYHIFYQILSNKKPELLDMLLVTNNPYDYAFV  314

151 SQGEVSVASIDDSEELMATDSAFDVLGFTSEEKAGVYKLTGAIMHYGNMK  200
    ||||||||||||||||||||||||||||||||||||||||||||||||||
315 SQGEVSVASIDDSEELMATDSAFDVLGFTSEEKAGVYKLTGAIMHYGNMK  364

201 FKQKQREEQAEPDGTEDADKSAYLMGLNSADLLKGLCHPRVKVGNEYVTK  250
    ||||||||||||||||||||||||||||||||||||||||||||||||||
365 FKQKQREEQAEPDGTEDADKSAYLMGLNSADLLKGLCHPRVKVGNEYVTK  414

251 GQSVQQVYYSIGALAKAVYEKMFNWMVTRINATLETKQPRQYFIGVLDIA  300
    ||||||||||||||||||||||||||||||||||||||||||||||||||
415 GQSVQQVYYSIGALAKAVYEKMFNWMVTRINATLETKQPRQYFIGVLDIA  464

301 GFEIFDFNSFEQLCINFTNEKLQQFFNHHMFVLEQEEYKKEGIEWTFIDF  350
    ||||||||||||||||||||||||||||||||||||||||||||||||||
465 GFEIFDFNSFEQLCINFTNEKLQQFFNHHMFVLEQEEYKKEGIEWTFIDF  514

351 GMDLQACIDLIEKPMGIMSILEEECMFPKATDMTFKAKLYDNHLGKSNNF  400
    ||||||||||||||||||||||||||||||||||||||||||||||||||
515 GMDLQACIDLIEKPMGIMSILEEECMFPKATDMTFKAKLYDNHLGKSNNF  564

401 QKPRNIKGKQEAHFSLIHYAGTVDYNILGWLEKNKDPLNETVVALYQKSS  450
    ||||||||||||||||||||||||||||||||||||||||||||||||||
565 QKPRNIKGKQEAHFSLIHYAGTVDYNILGWLEKNKDPLNETVVALYQKSS  614

451 LKLMATLFSSYATADTGDSGKSKGGKKKGSSFQTVSALHRENLNKLMTNL  500
    ||||||||||||||||||||||||||||||||||||||||||||||||||
615 LKLMATLFSSYATADTGDSGKSKGGKKKGSSFQTVSALHRENLNKLMTNL  664

501 RTTHPHFVRCIIPNERKAPGVMDNPLVMHQLRCNGVLEGIRICRKGFPNR  550
    ||||||||||||||||||||||||||||||||||||||||||||||||||
665 RTTHPHFVRCIIPNERKAPGVMDNPLVMHQLRCNGVLEGIRICRKGFPNR  714

551 ILYGDFRQRYRILNPVAIPEGQFIDSRKGTEKLLSSLDIDHNQYKFGHTK  600
    ||||||||||||||||||||||||||||||||||||||||||||||||||
715 ILYGDFRQRYRILNPVAIPEGQFIDSRKGTEKLLSSLDIDHNQYKFGHTK  764

601 VFFKAGLLGLLEEMRDERLSRIITRMQAQARGQLMRIEFKKIVERRDALL  650
    ||||||||||||||||||||||||||||||||||||||||||||||||||
765 VFFKAGLLGLLEEMRDERLSRIITRMQAQARGQLMRIEFKKIVERRDALL  814

651 VIQWNIRAFMGVKNWPWMKLYFKIKPLLKSAETEKEMATMKEEFGRIKET  700
    ||||||||||||||||||||||||||||||||||||||||||||||||||
815 VIQWNIRAFMGVKNWPWMKLYFKIKPLLKSAETEKEMATMKEEFGRIKET  864

701 LEKSEARRKELEEKMVSLLQEKNDLQLQVQAEQDNLNDAEERCDQLIKNK  750
    ||||||||||||||||||||||||||||||||||||||||||||||||||
865 LEKSEARRKELEEKMVSLLQEKNDLQLQVQAEQDNLNDAEERCDQLIKNK  914

751 IQLEAKVKEMNERLEDEEEMNAELTAKKRKLEDECSELKKDIDDLELTLA  800
    ||||||||||||||||||||||||||||||||||||||||||||||||||
915 IQLEAKVKEMNERLEDEEEMNAELTAKKRKLEDECSELKKDIDDLELTLA  964
```

-continued

```
 801 KVEKEKHATENKVKNLTEEMAGLDEIIAKLTKEKKALQEAHQQALDDLQV  850
     ||||||||||||||||||||||||||||||||||||||||||||||||||
 965 KVEKEKHATENKVKNLTEEMAGLDEIIAKLTKEKKALQEAHQQALDDLQV 1014

851 EEDKVNSLSKSKVKLEQQVDDLEGSLEQEKKVRMDLERAKRKLEGDLKLT  900
     ||||||||||||||||||||||||||||||||||||||||||||||||||
1015 EEDKVNSLSKSKVKLEQQVDDLEGSLEQEKKVRMDLERAKRKLEGDLKLT 1064

901 QESIMDLENDKLQLEEKLKKKEFDINQQNSKIEDEQALALQLQKKLKENQ  950
     ||||||||||||||||||||||||||||||||||||||||||||||||||
1065 QESIMDLENDKLQLEEKLKKKEFDINQQNSKIEDEQALALQLQKKLKENQ 1114

951 ARIEELEEELEAERTARAKVEKLRSDLSRELEEISERLEEAGGATSVQIE 1000
     ||||||||||||||||||||||||||||||||||||||||||||||||||
1115 ARIEELEEELEAERTARAKVEKLRSDLSRELEEISERLEEAGGATSVQIE 1164

1001 MNKKREAEFQKMRRDLEEATLQHEATAAALRKKHADSVAELGEQIDNLQR 1050
     ||||||||||||||||||||||||||||||||||||||||||||||||||
1165 MNKKREAEFQKMRRDLEEATLQHEATAAALRKKHADSVAELGEQIDNLQR 1214

1051 VKQKLEKEKSEFKLELDDVTSNMEQIIKAKANLEKVSRTLEDQANEYRVK 1100
     ||||||||||||||||||||||||||||||||||||||||||||||||||
1215 VKQKLEKEKSEFKLELDDVTSNMEQIIKAKANLEKVSRTLEDQANEYRVK 1264

1101 LEEAQRSLNDFTTQRAKLQTENGELARQLEEKEALISQLTRGKLSYTQQM 1150
     ||||||||||||||||||||||||||||||||||||||||||||||||||
1265 LEEAQRSLNDFTTQRAKLQTENGELARQLEEKEALISQLTRGKLSYTQQM 1314

1151 EDLKRQLEEEGKAKNALAHALQSARHDCDLLREQYEEETEAKAELQRVLS 1200
     ||||||||||||||||||||||||||||||||||||||||||||||||||
1315 EDLKRQLEEEGKAKNALAHALQSARHDCDLLREQYEEETEAKAELQRVLS 1364

1201 KANSEVAQWRTKYETDAIQRTEELEEAKKKLAQRLQDAEEAVEAVNAKCS 1250
     ||||||||||||||||||||||||||||||||||||||||||||||||||
1365 KANSEVAQWRTKYETDAIQRTEELEEAKKKLAQRLQDAEEAVEAVNAKCS 1414

1251 SLEKTKHRLQNEIEDLMVDVERSNAAAAALDKKQRNFDKILAEWKQKYEE 1300
     ||||||||||||||||||||||||||||||||||||||||||||||||||
1415 SLEKTKHRLQNEIEDLMVDVERSNAAAAALDKKQRNFDKILAEWKQKYEE 1464

1301 SQSELESSQKEARSLSTELFKLKNAYEESLEHLETFKRENKNLQEEISDL 1350
     ||||||||||||||||||||||||||||||||||||||||||||||||||
1465 SQSELESSQKEARSLSTELFKLKNAYEESLEHLETFKRENKNLQEEISDL 1514

1351 TEQLGEGGKNVHELEKVRKQLEVEKLELQSALEEAEASLEHEEGKILRAQ 1400
     ||||||||||||||||||||||||||||||||||||||||||||||||||
1515 TEQLGEGGKNVHELEKVRKQLEVEKLELQSALEEAEASLEHEEGKILRAQ 1564

1401 LEFNQIKAEIERKLAEKDEEMEQAKRNHQRVVDSLQTSLDAETRSRNEVL 1450
     ||||||||||||||||||||||||||||||||||||||||||||||||||
1565 LEFNQIKAEIERKLAEKDEEMEQAKRNHQRVVDSLQTSLDAETRSRNEVL 1614

1451 RVKKKMEGDLNEMEIQLSHANRMAAEAQKQVKSLQSLLKDTQIQLDDAVR 1500
     ||||||||||||||||||||||||||||||||||||||||||||||||||
1615 RVKKKMEGDLNEMEIQLSHANRMAAEAQKQVKSLQSLLKDTQIQLDDAVR 1664

1501 ANDDLKENIAIVERRNNLLQAELEELRAVVEQTERSRKLAEQELIETSER 1550
     ||||||||||||||||||||||||||||||||||||||||||||||||||
1665 ANDDLKENIAIVERRNNLLQAELEELRAVVEQTERSRKLAEQELIETSER 1714

1551 VQLLHSQNTSLINQKKKMESDLTQLQSEVEEAVQECRNAEEKAKKAITDA 1600
     ||||||||||||||||||||||||||||||||||||||||||||||||||
1715 VQLLHSQNTSLINQKKKMESDLTQLQSEVEEAVQECRNAEEKAKKAITDA 1764

1601 AMMAEELKKEQDTSAHLERMKKNMEQTIKDLQHRLDEAEQIALKGGKKQL 1650
     ||||||||||||||||||||||||||||||||||||||||||||||||||
1765 AMMAEELKKEQDTSAHLERMKKNMEQTIKDLQHRLDEAEQIALKGGKKQL 1814

1651 QKLEARVRELEGELEAEQKRNAESVKGMRKSERRIKELTYQTEEDKKNLL 1700
     ||||||||||||||||||||||||||||||||||||||||||||||||||
1815 QKLEARVRELEGELEAEQKRNAESVKGMRKSERRIKELTYQTEEDKKNLL 1864

1701 RLQDLVDKLQLKVKAYKRQAEEAEEQANTNLSKFRKVQHELDEAEERADI 1750
     ||||||||||||||||||||||||||||||||||||||||||||||||||
1865 RLQDLVDKLQLKVKAYKRQAEEAEEQANTNLSKFRKVQHELDEAEERADI 1914

1751 AESQVNKLRAKSRDIGAKQKMHDEE                          1775
     |||||||||||||||||||||||||
1915 AESQVNKLRAKSRDIGAKQKMHDEE                          1939
```

Sequence name: MYH6_HUMAN_V3 (SEQ ID NO:340)

Sequence documentation:

Alignment of: HSACMHCP_PEA_1_P29 (SEQ ID NO:334)×MYH6_HUMAN_V3 (SEQ ID NO:340)

| Alignment segment 1/1: | | | |
|---|---|---|---|
| Quality: | 7441.00 | Escore: | 0 |
| Matching length: | 775 | Total length: | 775 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
   1 MNKKREAEFQKMRRDLEEATLQHEATAAALRKKHADSVAELGEQIDNLQR   50
     ||||||||||||||||||||||||||||||||||||||||||||||||||
1165 MNKKREAEFQKMRRDLEEATLQHEATAAALRKKHADSVAELGEQIDNLQR 1214

51 VKQKLEKEKSEFKLELDDVTSNMEQIIKAKANLEKVSRTLEDQANEYRVK  100
     ||||||||||||||||||||||||||||||||||||||||||||||||||
1215 VKQKLEKEKSEFKLELDDVTSNMEQIIKAKANLEKVSRTLEDQANEYRVK 1264

101 LEEAQRSLNDFTTQRAKLQTENGELARQLEEKEALISQLTRGKLSYTQQM  150
     ||||||||||||||||||||||||||||||||||||||||||||||||||
1265 LEEAQRSLNDFTTQRAKLQTENGELARQLEEKEALISQLTRGKLSYTQQM 1314

151 EDLKRQLEEEGKAKNALAHALQSARHDCDLLREQYEEETEAKAELQRVLS  200
     ||||||||||||||||||||||||||||||||||||||||||||||||||
1315 EDLKRQLEEEGKAKNALAHALQSARHDCDLLREQYEEETEAKAELQRVLS 1364

201 KANSEVAQWRTKYETDAIQRTEELEEAKKKLAQRLQDAEEAVEAVNAKCS  250
     ||||||||||||||||||||||||||||||||||||||||||||||||||
1365 KANSEVAQWRTKYETDAIQRTEELEEAKKKLAQRLQDAEEAVEAVNAKCS 1414

251 SLEKTKHRLQNEIEDLMVDVERSNAAAAALDKKQRNFDKILAEWKQKYEE  300
     ||||||||||||||||||||||||||||||||||||||||||||||||||
1415 SLEKTKHRLQNEIEDLMVDVERSNAAAAALDKKQRNFDKILAEWKQKYEE 1464

301 SQSELESSQKEARSLSTELFKLKNAYEESLEHLETFKRENKNLQEEISDL  350
     ||||||||||||||||||||||||||||||||||||||||||||||||||
1465 SQSELESSQKEARSLSTELFKLKNAYEESLEHLETFKRENKNLQEEISDL 1514

351 TEQLGEGGKNVHELEKVRKQLEVEKLELQSALEEAEASLEHEEGKILRAQ  400
     ||||||||||||||||||||||||||||||||||||||||||||||||||
1515 TEQLGEGGKNVHELEKVRKQLEVEKLELQSALEEAEASLEHEEGKILRAQ 1564

401 LEFNQIKAEIERKLAEKDEEMEQAKRNHQRVVDSLQTSLDAETRSRNEVL  450
     ||||||||||||||||||||||||||||||||||||||||||||||||||
1565 LEFNQIKAEIERKLAEKDEEMEQAKRNHQRVVDSLQTSLDAETRSRNEVL 1614

451 RVKKKMEGDLNEMEIQLSHANRMAAEAQKQVKSLQSLLKDTQIQLDDAVR  500
     ||||||||||||||||||||||||||||||||||||||||||||||||||
1615 RVKKKMEGDLNEMEIQLSHANRMAAEAQKQVKSLQSLLKDTQIQLDDAVR 1664

501 ANDDLKENIAIVERRNNLLQAELEELRAVVEQTERSRKLAEQELIETSER  550
     ||||||||||||||||||||||||||||||||||||||||||||||||||
1665 ANDDLKENIAIVERRNNLLQAELEELRAVVEQTERSRKLAEQELIETSER 1714

551 VQLLHSQNTSLINQKKKMESDLTQLQSEVEEAVQECRNAEEKAKKAITDA  600
     ||||||||||||||||||||||||||||||||||||||||||||||||||
1715 VQLLHSQNTSLINQKKKMESDLTQLQSEVEEAVQECRNAEEKAKKAITDA 1764

601 AMMAEELKKEQDTSAHLERMKKNMEQTIKDLQHRLDEAEQIALKGGKKQL  650
     ||||||||||||||||||||||||||||||||||||||||||||||||||
1765 AMMAEELKKEQDTSAHLERMKKNMEQTIKDLQHRLDEAEQIALKGGKKQL 1814

651 QKLEARVRELEGELEAEQKRNAESVKGMRKSERRIKELTYQTEEDKKNLL  700
     ||||||||||||||||||||||||||||||||||||||||||||||||||
1815 QKLEARVRELEGELEAEQKRNAESVKGMRKSERRIKELTYQTEEDKKNLL 1864

701 RLQDLVLKLQLKVKAYKRQAEEAEEQANTNLSKFRKVQHELDEAEERADI  750
     ||||||||||||||||||||||||||||||||||||||||||||||||||
1865 RLQDLVLKLQLKVKAYKRQAEEAEEQANTNLSKFRKVQHELDEAEERADI 1914

751 AESQVNKLRAKSRDIGAKQKMHDEE                          775
     |||||||||||||||||||||||||
1915 AESQVNKLRAKSRDIGAKQKMHDEE                         1939
```

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention.

SEQUENCE LISTING (452 sequences)

SEQ ID NO: 1 - DNA, 2110 bp, Homo sapiens
tctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgagctctgaagcccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctggtaagatgggcaactttggagctatatctgattggttattactactgctctttcagccaagcctgttctaaaaagccaagtcctcccctgagagctgtagaagctgggacaagagagtggttgtgggtcagggtggtatcaggtgggaattttctgtgtagtggctttggactcacacaggccggaactcaaatcttaccttataggctacatgactgtgggcaaatcaccttttccaagtgcaactgtaaaacgggtattaataataccaaccttgtagggctgctgggaagcctgtaagagacagtgtatgcacagcacaaagcatcactgattgaggaacacagcaggtgctccatgtcctttgtttgctcttcctgtgtttctaccttgcctcacctcaggaagaagtagaaaacagggccaaatctgatcccaggccctctaggaggggctcccattgcctatctcagcattccctttcctctcctccctaggactgcattgtcacttgcagggacaggctcgtgactggtggggacactgaatgacagtacagtcctttcttccccattctagtcctaccccattttcatgctttctatgtctggcctactgaaactacttgactactgcttgggtaggaagtaccacagccaggctggcagatctgttcaagcttggggacttcacttggagaatctagccttgactgaattccccccagacccagggagagcagccaactgtggattctgcctaaccacagggcctcaggttttcacctaggcatcttcactgcacaccttcttgggtcagcataacctgttaactgcat

SEQ ID NO: 2 - DNA, 1733 bp, Homo sapiens
tctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgagctctgaagcccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctggatgttctgacagcctggccaagcatctacaggagacaagtcaaagttttaagagaagatgaaataacaattcttccttggcatctccaatggagtagagagaaggcaacaaagcttctcagacccacattaccgagctataacaaccatggctgggaggagctgagagttggcaaatcaatagtttagctatgttgctgaaccttcctggatggcaagaccatggaagtccatcacaagatattatggggtcaggagcctcactgggttctgccccttatataggtgaatatcctgggaaagtaaaaatgaaaatacagagtctggcaccagttccctgcaagcctggtccagcctggataaagaagtgaggagagtaataatactgccttacacctaaacagtgctttagtttatcaagctttttgcatccttatcttacaataatagtctgtagagtc

SEQ ID NO: 3 - DNA, 1822 bp, Homo sapiens
tctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgagctctgaagcccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgatggaaaaactgcaactcagaaatgtaaagtgagtcgaccaaggctaaagcggcaaaaccactatactttataacacagagtttggcactatttccactttgttctctctcaaagatgaaggctcaggaggagggaagataaaaacaaatcactggagagtcctggcatgctggaacatggactctagctagcaagaagggctcaaggaggtggccttctcctagacctcaactttgatgcaaaagctgttttgcagcctgaacaaagacaatccaatcctccagcaaatggcgtcattttccctacgtgtctagccttgagctacagaacaaaagaacaatcacatccgaagttgtagttcgcctggttgcggtggctcacgcctgtgatcccagcactttgggaggccaaggtgggtggatcacctgaggtcaggaggtcgagactagcctgaccaacatgaagaaaccccatctctactaaaaatacaaaattagctgggcgtggtggcacatgcctgtaatcccagctactcgggaggctgaggca

SEQ ID NO: 4 - DNA, 3531 bp, Homo sapiens
tctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgagctctgaagcccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcgctcatatactcataaccttccccctaccctcaggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgtaagttacccaggaagaaggattataggaaaaataactcagtaagtttaaaaccaaacacatttccatttagtgacaggaatttaagcaaggacctgaagtagaatcaactgattcacacagtagtaaatacaaagtagaacaatgatcttggcttcgctgtctggttcagtggtctgctggaatgcaatacacaagttaagtcacactgcagactgttttctagctgtggccgctggatgccacttctagcatagtagaactatgttaggaggaatgggaaaagtgagcaccacttctcaccatgttcccccctcctgctgccagtctctgctcccatgttggatgcagcagagatcacccaccagttggcccaggacagaccaataggaagggtccaatcactctaactacagccgaactcacctccacaacagtctctgtggctctagcctggactcctttacaggaatccagctctggcagtggcagctggagagggtaatagggcctcctgctgaatgaaggaagttgggtgaatgaatgggtgagctgcagggttcacttgcaaagggaccaggagtgataaggaaacaacaactcattcaggcagctgcttttgacctctaactcccaaacctgcctgttgcatgaggggaagccatctcccatgggagcgaagttaatggggtgggaggctatattctcactattgagtctttccaggagtctcaaggcacaaggctcctggtttcttactctcaaccaccccctacactctttatactctcactccttgtgcttcttcttgtgcttcttcttctttttcttcttctttgctgccttgctgtcttttgatgtgtgccttgccctcttgcctgtatcactctcagagtctgagctgtcagagtcagatgacttcctatctctatgtttctttttcttcttctcctgaaaagaaaattttaaaaatcaacactgtatgtgtatatttgcttttaacaatcatagcacataattggccaggtgcagtggctcacacctgtaatcctagtactttgggaagccgaggtgggaggaatgcttgaggccaggagttcaagatcaacctggctaacatagcaagatctcatctctaaaaagagaaaaaaagaaaaattatagcacacaatcaataggggaccacttaattttcttttagacagtctcgctctgttgcccaggctagagtgcagtgcagtggcacgatcacagctcactgcaacctca

SEQ ID NO: 5 - DNA, 2778 bp, Homo sapiens
atgcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacggcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactgggttttgatgaagaaggaagcctgtatattcttaagggtgatcgcacaatagagtttgatggcgagtttgcagctgatgtcttggtggagttcctcttggatctaattgaagacccagtggagatcatcagcagcaaactggaagtccaagccttcgaacgcattgaagactacatcaaactcattggctttttcaagagtgaggactcagaatactacaaggcttttgaagaagcagctgaacacttccagccttacatcaaattctttgccacctttgacaaaggggtgctgtggctcacacctgtaatcccaacactttgggaggctgacgggggtggattgcatgagccttggagttggagaccagcctgggcaacatggttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaatcct

SEQ ID NO: 6 - DNA, 2824 bp, Homo sapiens
atgcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacggcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcactggcaaatatcccagtggtggttgcatttccaaaccccaagagaggaaggcaaaatgaagttgctggagttgagtgaatctgcagatggagctgcgtggaaacgctggggagggaatagcaacacacacaggattcagcttgtggcccaggtccttgaacataaagctataggctttgtgatggtggatgccaagaaagaagccaagcttgccaagaaactgggttttgatgaagaaggaagcctgtatattcttaagggtgatcgcacaatagagtttgatggcgagtttgcagctgatgtcttggtggagttcctcttggatctaattgaagacccagtggagatcatcagcagcaaactggaagtccaagccttcgaacgcattgaagactacatcaaactcattggctttttcaagagtgaggactcagaatactacaaggcttttgaagaagcagctgaacacttccagccttacatcaaattctttgccacctttgacaaaggggttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaatcct

SEQ ID NO: 7 - DNA, 2497 bp, Homo sapiens
atgcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacggcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactgggttttgatgaagaaggaagcctgtatattcttaagggtgatcgcacaatagagtttgatggcgagtttgcagctgatgtcttggtggagttcctcttggatgttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaatcct

SEQ ID NO: 8 - DNA, 2209 bp, Homo sapiens
taatgagacagaggctgagcagagctatgtaagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactggactacaaggcttttgaagaagcagctgaacacttccagccttacatcaaattctttgccacctttgacaaaggggttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaatcct

SEQ ID NO: 9 - DNA, 1951 bp, Homo sapiens
tgcaggcaaacagcaaccattctgccttgacaacacactgaacatgtggctgctttaatccagagagaaaatgtcttcctggctatcggctggctctccgagctctttatctgttgttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaatcct

SEQ ID NO: 10 - DNA, 1740 bp, Homo sapiens
tctatagaataatcctataattgagggtgagcaccaaatgtcctaagaagtcctcgtggaaaaatcacactctgctctccacattagaagctgtgtatgtgcaggggttactcaactctcttgaatcctgtttcagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaatcct

SEQ ID NO: 11 - DNA, 1259 bp, Homo sapiens
atgcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacggcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactgggttttgatgaagaaggaagcctgtatattcttaagggtgatcgcacaatagagtttgatggcgagtttgcagctgatgtcttggtggagttcctcttggatctaattgaagacccagtggagatcatcagcagcaaactggaagtccaagccttcgaacgcattgaagactacatcaaactcattggctttttcaagagtgaggactcagaatactacaaggcttttgaagaagcagctgaacacttccagccttacatcaaattctttgccacctttgacaaaggggttgcaaagaaattatctttgaagatgaatgaggttgacttctatgagccatttatggatgagcccattgccatccccaacaaaccttacacagaagaggagctggtggagtttgtgaaggaacaccaaagatcaaggaattggactcaatagttaagtaacttagccaaggatgaacactctatgcatagaacttctgggagagaaatgcttgataccacttagtgtagctccagcatggatcagcaaactttttctgtaaagaacaaaatggtaaatatttcaggttctgtgggccagatggcgtctgtagcaactacttgactgcggctgtggcatgaaagcagccatggatcatgtataaacaaatgggtgtggctgtgtaccagtaaaagtttatccggaaaaaaag

SEQ ID NO: 12 - DNA, 2412 bp, Homo sapiens
gggggggccttcgcggtgcagctgaggctgcaagtagccggcgccgtcccgcgtcgcccccgcgcagggcgggccccgcacgcttatcctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaacttgtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctactaaaaaaat

SEQ ID NO: 13 - DNA, 2393 bp, Homo sapiens
tagcagtggtgttcagggtaggatgcagttcttcgcattgtgcataacacaagccctgaaccagctgctttgggaacccctgggaataaagtgccctacctgcctttcaggcactgccaagcctggggcatctctggagattgtgtatccgagtttcaggagaccatggagatcagcctcgtaaaatgctcggaggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaacttgtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctactaaaaaaat

SEQ ID NO: 14 - DNA, 2497 bp, Homo sapiens
gggggggccttcgcggtgcagctgaggctgcaagtagccggcgccgtcccgcgtcgcccccgcgcagggcgggccccgcacgcttatcctgcccgggaggaacgccggcgtccagcccgctaccgaccgccgctgcgggatgctgcgctccacgtccacggtcaccctgctctcgggcggcgccgccaggacgcccggggcgcccagcaggagggcactgccaagcctggggcatctctggagattgtgtatccgagtttcaggagaccatggagatcagcctcgtaaaatgctcggaggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaacttgtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctactaaaaaaat

SEQ ID NO: 15 - DNA, 2328 bp, Homo sapiens
gggggggccttcgcggtgcagctgaggctgcaagtagccggcgccgtcccgcgtcgcccccgcgcagggcgggccccgcacgcttatcctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaacttgtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctactaaaaaaat

SEQ ID NO: 16 - DNA, 2311 bp, Homo sapiens
gggggggccttcgcggtgcagctgaggctgcaagtagccggcgccgtcccgcgtcgcccccgcgcagggcgggccccgcacgcttatcctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaacttgtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctactaaaaaaat

SEQ ID NO: 17 - DNA, 1418 bp, Homo sapiens
gggggggccttcgcggtgcagctgaggctgcaagtagccggcgccgtcccgcgtcgcccccgcgcagggcgggccccgcacgcttatcctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagatcatgtcgcacgagctcttctccagatttagtctccggctctttggaagatgataagttggtagcctgctctgggttggaagcgattcctttattgttcgtgattagaagaacacttgtacactctctgctgggaagaggtggtatttatctatgatga

SEQ ID NO: 18 - DNA, 1027 bp, Homo sapiens
gttggccctgacctcgttggaaaacgaagctccccgcagggtcccggcctctagggctgctgtgcgggcgggggtggcctggagctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagcccctggtggacttgtacagccgccggtacttcctgaccgtcccgtatgaagagtgcaagtggaggagaagtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgtttttttaactgttgg

SEQ ID NO: 19 - DNA, 955 bp, Homo sapiens
gttggccctgacctcgttggaaaacgaagctccccgcagggtcccggcctctagggctgctgtgcgggcgggggtggcctggagctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaatctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgtttttttaactgttgg

SEQ ID NO: 20 - DNA, 986 bp, Homo sapiens
ggttggattcctgggagcttcatcacatttggttctcagctgactttatatactaaaaaataacttcctttcgcctgaccatggagagggactgccaggggtgaaggcagccctgtctgaggccagaggtctgcccacgtggcggatgaggcaggtgtgaggccagcttgagcatctggatccatttgtctcgggctgctggctgcctgccatttcctcctctccacccttatttggaggccctgacagctgagccacaaacaaaccaggggagctgggcaccagccaagcgtcaccctctgtttccccgcacgggtaccagcgtcgaggagaaagaatcctgaggcacggcgaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtactgaagataacagccagggaggacaagcagggctgggcctagggacagactgcaagaggctcctgtcccctggggtctctgctgcatttgtgtcatcttgttgccatggagttgtgatcatcccatctaagctgcagcttcctgtcaacacttctcacatcttatgctaactgtagataaagtggtttgatggtgacttcctcgcctctcccaccccatgcattaaattttaaggtagaacctcacctgttactgaaagtggtttgaaagtgaataaacttcagcaccatggacagaagacaaa

SEQ ID NO: 21 - DNA, 760 bp, Homo sapiens
ctgggagacagggacagacgtaggccaagagaggggaaccagagaggaaccagaggggagagacagagcagcaagcagtggattgctccttgacgacgccagcatgagctccttctccaccaccaccaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtactgaagataacagccagggaggacaagcagggctgggcctagggacagactgcaagaggctcctgtcccctggggtctctgctgcatttgtgtcatcttgttgccatggagttgtgatcatcccatctaagctgcagcttcctgtcaacacttctcacatcttatgctaactgtagataaagtggtttgatggtgacttcctcgcctctcccaccccatgcattaaattttaaggtagaacctcacctgttactgaaagtggtttgaaagtgaataaacttcagcaccatggacagaagacaaa

SEQ ID NO: 22 - DNA, 892 bp, Homo sapiens
tctcagtgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggagcagcgatgcggtgagagcagcgggctaaggcgtggctgggacccccagggccagggctagggaacctcgccctgcaccagccccaatcagacgccgctcctccaactaccgcgcttatgccacggagccgcacgccaagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaa

SEQ ID NO: 23 - DNA, 763 bp, Homo sapiens
tctcagtgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggagcagcgatgcgaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaa

SEQ ID NO: 24 - DNA, 1381 bp, Homo sapiens
tctcagtgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggagcagcgatgcggctagggaacctcgccctgcaccagccccaatcagacgccgctcctccaactaccgcgcttatgccacggagccgcacgccaagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggaggtgggacgcatgggcagctcgggtaccttcggggtagggtgagatggctgggacttggtctctgcctgaccccttgcagctgcttttggctgcacatcccaggagacccaggacaactgtgagcctggcagggctggggcagaaggatgagtacaatatagtcaaggaaagctgttctaggcagagggaacagcacatgcaaggccatgggttgggaaacagaaaataagttagtgaacatgctcagggcatcacatgttggtaaattagctcaggcactggccagggaattgtgatttgcatgtagctggaccaggttatgccagtggttttgagaggtgaggctggagcatatgaggagggggattcagttccaggattagaagcctagactgggagcctaagccgggaagagactggtaaggcctcggtactggaagacgagataaggagaataaaaaaggagtgtaggatggaggagttgggtgtgcgggaaatggaaggagaagtacccaccccctcgtgtgcccccagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaa

SEQ ID NO: 25 - DNA, 1252 bp, Homo sapiens
tctcagtgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggagcagcgatgcggctagggaacctcgccctgcaccagccccaatcagacgccgctcctccaactaccgcgcttatgccacggagccgcacgccaaggtgggacggggcttcctgggggcagagtacaggcgccggagggatccaagaccctgggagtggggggaggagccagggctgcgaagggggcggggactacgcggaggggcttcaggggcggagttttgcagagggtcatgctcggattggtgacagcagcctgcgggcggaactccgttgccctcggacttgcttagggatagatgggaagtgcctatccaaaggaagagacccagattggtggatgggaatgaggggcgtggcctcccgtagactcagggctcaagttggacgtgggcccaaatctggaccggctgggtttgctgggggtgtcttgaggtcccctccaccgtcgtctccgaatccccctccatgatccttccttgctccatctcaccctggcagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaa

SEQ ID NO: 26 - DNA, 2820 bp, Homo sapiens
ttccatgctctttaaaagccttataattttctggatctgggagctgggctatttcagggtcaatggatttatttcagttggtgcctgaactgacttgaaacaagtgtgtgtggaaaagagctattttgagaaggaataaaccgagactgccctgatgatagaatatgcaagctggtgggtcttgactccttaaaggattatgaaattaatttgattggtcccaatctttatataaccaccccaatcaggaaacttcccatcccgccaaaaggccccctcacgtgctctccctgtcagtaccccatgcaaaggtaaaatagatgatatttttaaacatgggtcgtgtttaaaagaaatggaaactccttcagagaatgaaggagaaccacactgggtagaaggttattcctggggctccaccccttgctccatcaagtcctctgagcatgagctgggctctgagaaggaagagacaggaaccaattggtcatgtccacgtggcctcagaagctgagtacgtgacggtcaccagatgcctaggcaggctcccttgaaatggcagggctgctgtccaaaatcctgctgggtcattgctatttacaggcagccttcccggcgtgcggtggatatcccaagcggggctatttttaagcagggctatggcctgccgtgggttaagctggtgtggacagaaagcgagatgatctagccatctactgcagggggcctgatcttgaacagaaacctgactgtaattgtccctggatccaggtcccagacaaagacgctggaaggaggtccctccagcccctggctcagggcccggtcagctgctggagccaggcagcttgagacatcctcctctccgaccttggcttgaggggttcatcctccagagctcaccagggccccaaggctggtacacctgagagaagagagaaacaaatcccccaacagatgtgcaatttcacctgctggcccttccattctgagatccagagccctggcaaaggagcctccaggaccaggcctgggaagcaagactggctccgccttttacgtttcagagaaagggcaggtgctataaagggcccagcgcccacgggcctgccttcaagggtacagctgtgggggccggtgcgcccggaggtctacgctgggattggtgaggtcctctggccccgccccgccagggaggatttccaggccggcccgaccagctcgccctgcatacacttcttggctgtgtgcgctcagcaggacgtgggaggctccggcttcaagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggtaacgtctctctcactttcctaacatgaactaacaaaatcagcctaagagagaatagagaaaagcaaacagcctagccgttttcacaaaattcgagacctcctcttcgcccattgagtcctgagttatgttagcttttcattctgtaacattattcttccatgggaaataactgcataaagggaaacataatgtgagctgagaatttataggcaagtataggaattcacagtgggactgttgtcaccgacctgccatgagagctattccaacaatcctcagcgagcaggagctctgttatgctaaaggactgcagtttttttattactgtaaagtcagaacatctatgctatccctctgagggtggcaaaatagt

SEQ ID NO: 27 - DNA, 2448 bp, Homo sapiens
ttccatgctctttaaaagccttataattttctggatctgggagctgggctatttcagggtcaatggatttatttcagttggtgcctgaactgacttgaaacaagtgtgtgtggaaaagagctattttgagaaggaataaaccgagactgccctgatgatagaatatgcaagctggtgggtcttgactccttaaaggattatgaaattaatttgattggtcccaatctttatataaccaccccaatcaggaaacttcccatcccgccaaaaggccccctcacgtgctctccctgtcagtaccccatgcaaaggtaaaatagatgatatttttaaacatgggtcgtgtttaaaagaaatggaaactccttcagagaatgaaggagaaccacactgggtagaaggttattcctggggctccaccccttgctccatcaagtcctctgagcatgagctgggctctgagaaggaagagacaggaaccaattggtcatgtccacgtggcctcagaagctgagtacgtgacggtcaccagatgcctaggcaggctcccttgaaatggcagggctgctgtccaaaatcctgctgggtcattgctatttacaggcagccttcccggcgtgcggtggatatcccaagcggggctatttttaagcagggctatggcctgccgtgggttaagctggtgtggacagaaagcgagatgatctagccatctactgcagggggcctgatcttgaacagaaacctgactgtaattgtccctggatccaggtcccagacaaagacgctggaaggaggtccctccagcccctggctcagggcccggtcagctgctggagccaggcagcttgagacatcctcctctccgaccttggcttgaggggttcatcctccagagctcaccagggccccaaggctggtacacctgagagaagagagaaacaaatcccccaacagatgtgcaatttcacctgctggcccttccattctgagatccagagccctggcaaaggagcctccaggaccaggcctgggaagcaagactggctccgccttttacgtttcagagaaagggcaggtgctataaagggcccagcgcccacgggcctgccttcaagggtacagctgtgggggccggtgcgcccggaggtctacgctgggattggtgaggtcctctggccccgccccgccagggaggatttccaggccggcccgaccagctcgccctgcatacacttcttggctgtgtgcgctcagcaggacgtgggaggctccggcttcaagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggtactgttatgtgcccagtggccctgatgggccaggatcagctcagatgcgactgctttgtggaggaagaaaacatcactgcccattccttaacccttactttctctatctacaatataaaaataagaaa

SEQ ID NO: 28 - DNA, 2632 bp, Homo sapiens
ttccatgctctttaaaagccttataattttctggatctgggagctgggctatttcagggtcaatggatttatttcagttggtgcctgaactgacttgaaacaagtgtgtgtggaaaagagctattttgagaaggaataaaccgagactgccctgatgatagaatatgcaagctggtgggtcttgactccttaaaggattatgaaattaatttgattggtcccaatctttatataaccaccccaatcaggaaacttcccatcccgccaaaaggccccctcacgtgctctccctgtcagtaccccatgcaaaggtaaaatagatgatatttttaaacatgggtcgtgtttaaaagaaatggaaactccttcagagaatgaaggagaaccacactgggtagaaggttattcctggggctccaccccttgctccatcaagtcctctgagcatgagctgggctctgagaaggaagagacaggaaccaattggtcatgtccacgtggcctcagaagctgagtacgtgacggtcaccagatgcctaggcaggctcccttgaaatggcagggctgctgtccaaaatcctgctgggtcattgctatttacaggcagccttcccggcgtgcggtggatatcccaagcggggctatttttaagcagggctatggcctgccgtgggttaagctggtgtggacagaaagcgagatgatctagccatctactgcagggggcctgatcttgaacagaaacctgactgtaattgtccctggatccaggtcccagacaaagacgctggaaggaggtccctccagcccctggctcagggcccggtcagctgctggagccaggcagcttgagacatcctcctctccgaccttggcttgaggggttcatcctccagagctcaccagggccccaaggctggtacacctgagagaagagagaaacaaatcccccaacagatgtgcaatttcacctgctggcccttccattctgagatccagagccctggcaaaggagcctccaggaccaggcctgggaagcaagactggctccgccttttacgtttcagagaaagggcaggtgctataaagggcccagcgcccacgggcctgccttcaagggtacagctgtgggggccggtgcgcccggaggtctacgctgggattggtgaggtcctctggccccgccccgccagggaggatttccaggccggcccgaccagctcgccctgcatacacttcttggctgtgtgcgctcagcaggacgtgggaggctccggcttcaagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaatataaaaaactttgcttt

SEQ ID NO: 29 - DNA, 2382 bp, Homo sapiens
ttccatgctctttaaaagccttataattttctggatctgggagctgggctatttcagggtcaatggatttatttcagttggtgcctgaactgacttgaaacaagtgtgtgtggaaaagagctattttgagaaggaataaaccgagactgccctgatgatagaatatgcaagctggtgggtcttgactccttaaaggattatgaaattaatttgattggtcccaatctttatataaccaccccaatcaggaaacttcccatcccgccaaaaggccccctcacgtgctctccctgtcagtaccccatgcaaaggtaaaatagatgatatttttaaacatgggtcgtgtttaaaagaaatggaaactccttcagagaatgaaggagaaccacactgggtagaaggttattcctggggctccaccccttgctccatcaagtcctctgagcatgagctgggctctgagaaggaagagacaggaaccaattggtcatgtccacgtggcctcagaagctgagtacgtgacggtcaccagatgcctaggcaggctcccttgaaatggcagggctgctgtccaaaatcctgctgggtcattgctatttacaggcagccttcccggcgtgcggtggatatcccaagcggggctatttttaagcagggctatggcctgccgtgggttaagctggtgtggacagaaagcgagatgatctagccatctactgcagggggcctgatcttgaacagaaacctgactgtaattgtccctggatccaggtcccagacaaagacgctggaaggaggtccctccagcccctggctcagggcccggtcagctgctggagccaggcagcttgagacatcctcctctccgaccttggcttgaggggttcatcctccagagctcaccagggccccaaggctggtacacctgagagaagagagaaacaaatcccccaacagatgtgcaatttcacctgctggcccttccattctgagatccagagccctggcaaaggagcctccaggaccaggcctgggaagcaagactggctccgccttttacgtttcagagaaagggcaggtgctataaagggcccagcgcccacgggcctgccttcaagggtacagctgtgggggccggtgcgcccggaggtctacgctgggattggtgaggtcctctggccccgccccgccagggaggatttccaggccggcccgaccagctcgccctgcatacacttcttggctgtgtgcgctcagcaggacgtgggaggctccggcttcaagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtaagatgttatctgagatttctggatatttattaaaataaaattaccgtattgtttgttcttgaaagaagacactatggtaacttccaagatggagctaatttttttctagaaatcaaagcaactgccgcctcccaggttcaagtgattatcccgcctcagcctctagagtagctgggattacaggtgccaccaccac

SEQ ID NO: 30 - DNA, 2296 bp, Homo sapiens
ttccatgctctttaaaagccttataattttctggatctgggagctgggctatttcagggtcaatggatttatttcagttggtgcctgaactgacttgaaacaagtgtgtgtggaaaagagctattttgagaaggaataaaccgagactgccctgatgatagaatatgcaagctggtgggtcttgactccttaaaggattatgaaattaatttgattggtcccaatctttatataaccaccccaatcaggaaacttcccatcccgccaaaaggccccctcacgtgctctccctgtcagtaccccatgcaaaggtaaaatagatgatatttttaaacatgggtcgtgtttaaaagaaatggaaactccttcagagaatgaaggagaaccacactgggtagaaggttattcctggggctccaccccttgctccatcaagtcctctgagcatgagctgggctctgagaaggaagagacaggaaccaattggtcatgtccacgtggcctcagaagctgagtacgtgacggtcaccagatgcctaggcaggctcccttgaaatggcagggctgctgtccaaaatcctgctgggtcattgctatttacaggcagccttcccggcgtgcggtggatatcccaagcggggctatttttaagcagggctatggcctgccgtgggttaagctggtgtggacagaaagcgagatgatctagccatctactgcagggggcctgatcttgaacagaaacctgactgtaattgtccctggatccaggtcccagacaaagacgctggaaggaggtccctccagcccctggctcagggcccggtcagctgctggagccaggcagcttgagacatcctcctctccgaccttggcttgaggggttcatcctccagagctcaccagggccccaaggctggtacacctgagagaagagagaaacaaatcccccaacagatgtgcaatttcacctgctggcccttccattctgagatccagagccctggcaaaggagcctccaggaccaggcctgggaagcaagactggctccgccttttacgtttcagagaaagggcaggtgctataaagggcccagcgcccacgggcctgccttcaagggtacagctgtgggggccggtgcgcccggaggtctacgctgggattggtgaggtcctctggccccgccccgccagggaggatttccaggccggcccgaccagctcgccctgcatacacttcttggctgtgtgcgctcagcaggacgtgggaggctccggcttcaagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgcataattatgataagacatttctcatctggataaatgaggaggatcacaccagggtaatctcaatggaaaaaggaggcaatatgaaacgagtatttgagcgattctgtcgtggactaaaagaagtaagatgttatctgagatttctggatatttattaaaataaaattaccgtattgtttgttcttgaaagaagacactatggtaacttccaagatggagctaatttttttctagaaatcaaagcaactgccgcctcccaggttcaagtgattatcccgcctcagcctctagagtagctgggattacaggtgccaccaccac

SEQ ID NO: 31 - DNA, 3189 bp, Homo sapiens
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccaggtgagacctcacctcacactcaaggctccactgggcctcaggatgcaccgggaccctctgaggacccccagccctaaatcctggcctctgacccaaccccttacccctgatgcaaccttgactccacaagcgatcctgactccaaccttaacctagacctagcctctggtccgggtctggtcccggccccatcctaactccgcccccggccacgccccacgctcactctctctccccgtccccgcctccagcactgtcagttctgctatctctgcccgctggtctgcgaaacggtctgcgctccaggaagctacgttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccga

SEQ ID NO: 32 - DNA, 3298 bp, Homo sapiens
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccaggtgagacctcacctcacactcaaggctccactgggcctcaggatgcaccgggaccctctgaggacccccagccctaaatcctggcctctgacccaaccccttacccctgatgcaaccttgactccacaagcgatcctgactccaaccttaacctagacctagcctctggtccgggtctggtcccggccccatcctaactccgcccccggccacgccccacgctcactctctctccccgtccccgcctccagcactgtcagttctgctatctctgcccgctggtctgcgaaacggtctgcgctccaggaagctacgttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccgaaacctcattgtcagacgtggggtctgggaatctcagggcatcggggaatgcgggtagggtctagagacctggacctagacttgagggatgaggggcctggactcctggc

SEQ ID NO: 33 - DNA, 3257 bp, Homo sapiens
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagcactgtcagttctgctatctctgcccgctggtctgcgaaacggtctgcgctccaggtgagcatgggcggggccctggaaaaacctgaggaaggtgccgggcccagcgtggtgaatcctggtgggggcggagcctggcccggtaggctggtggggcggggctaagaggggaggcgtggccaaggctctgagcacgtgggccggggcctggctcgaggaacaccaggtggagttgctggagccaagggacagaaatgagtggagggttgagatgcgggcttagagcctaatgggcgaggccaactcaagtaggaatcgaaggggcggggctactggagaacggaatcacccagaacgaaaaaggggtccggtagaagggattcagttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccga

SEQ ID NO: 34 - DNA, 3366 bp, Homo sapiens
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagcactgtcagttctgctatctctgcccgctggtctgcgaaacggtctgcgctccaggtgagcatgggcggggccctggaaaaacctgaggaaggtgccgggcccagcgtggtgaatcctggtgggggcggagcctggcccggtaggctggtggggcggggctaagaggggaggcgtggccaaggctctgagcacgtgggccggggcctggctcgaggaacaccaggtggagttgctggagccaagggacagaaatgagtggagggttgagatgcgggcttagagcctaatgggcgaggccaactcaagtaggaatcgaaggggcggggctactggagaacggaatcacccagaacgaaaaaggggtccggtagaagggattcagttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccgaaacctcattgtcagacgtggggtctgggaatctcagggcatcggggaatgcgggtagggtctagagacctggacctagacttgagggatgaggggcctggactcctggc

SEQ ID NO: 35 - DNA, 3508 bp, Homo sapiens
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccaggtgagacctcacctcacactcaaggctccactgggcctcaggatgcaccgggaccctctgaggacccccagccctaaatcctggcctctgacccaaccccttacccctgatgcaaccttgactccacaagcgatcctgactccaaccttaacctagacctagcctctggtccgggtctggtcccggccccatcctaactccgcccccggccacgccccacgctcactctctctccccgtccccgcctccagcactgtcagttctgctatctctgcccgctggtctgcgaaacggtctgcgctccaggtgagcatgggcggggccctggaaaaacctgaggaaggtgccgggcccagcgtggtgaatcctggtgggggcggagcctggcccggtaggctggtggggcggggctaagaggggaggcgtggccaaggctctgagcacgtgggccggggcctggctcgaggaacaccaggtggagttgctggagccaagggacagaaatgagtggagggttgagatgcgggcttagagcctaatgggcgaggccaactcaagtaggaatcgaaggggcggggctactggagaacggaatcacccagaacgaaaaaggggtccggtagaagggattcagttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccga

SEQ ID NO: 36 - DNA, 2955 bp, Homo sapiens
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagggccctggcagacatgctggaaacgccggaaccctgacccagtcgctcgactgcgacgcaggtgtacctccccctgccttccaacccctttccacgagctatatttatttctccgaataaacgtgctccccgaaacctcattgtcagacgtggggtctgggaatctcagggcatcggggaatgcgggtagggtctagagacctggacctagacttgagggatgaggggcctggactcctggc

SEQ ID NO: 37 - DNA, 2867 bp, Homo sapiens
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacagcgatgcactgaatgtgagagctgtcactgtgatgaggagaacatgggtgagcactgcgaccagtgccagcactgtcagttctgctatctctgcccgctggtctgcgaaacggtctgcgctccaggaagctacgttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccga

SEQ ID NO: 38 - DNA, 2064 bp, Homo sapiens
acatattcagcagggttagcttgtcctcccctccctcttcagcttcccagacactgagtctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactggtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagagctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcatttataaacggacagctcttcatagagcatgcttggaaggacatttggcaattgtggagaagttaatggaagctggagcccagatcgaattccgtgatatgcttgaatccacagccatccactgggcaagccgtggaggaaacctggatgttttaaaattgttgctgaataaaggagcaaaaattagcgcccgagataagttgctcagcacagcgctgcatgtggcggtgaggactggccactatgagtgcgcggagcatcttatcgcctgtgaggcagacctcaacgccaaagacagagaaggagataccccgttgcatgatgcggtgagactgaaccgctataagatgatccgactcctgattatgtatggcgcggatctcaacatcaagaactgtgctgggaagacgccgatggatctggtgctacactggcagaatggaaccaaagcaatattcgacagcctcagagagaactcctacaagacctctcgcatagctacattctgaggcaaacgacagactcttaatcagtaaatgttcactggcattttgaaggcatggcccaagagaagagacactagccataaaatctagtttctatttatcaacgtgttgtgaagatgtacctaatgaagttttgagaaagcacagggttataggtgtttaaatttcctttagtgaaactcttatttatttttatgtattcctgtttatttatttactgccacgctactgatattcagaccttcatgatcatccatctggtgagcagagcttcatttgtatataacactttcagagccttcccacccataggtagttcttaaaccaggtgaaagagcaaagttcaagtgcctacttatgtgtcattcgctcatgtaagagtttttaagagagggctgattatcacagccctcttttctcctgaatttttaatgcagaagtttgaatgaagcaagggaaggcatgtagggacaggaaaggaaacaatggaaggaaagtgattctgtgaaaaggacagtgaagccagctattttacccccaggctggattttttttttttttttttttttttttttttaccgagtacacagagtacccaagtgaagagaacgtcatgagtgtaagtgcaaatcagtggaaggagcggcaaactgggacatgcagaattgaatttgctcaaaaaagatgaaaggaaatgcaaactgtaaatgtataaatgtatattgtattgtatgtacattttatattcataataaaggcaatcaaactctaaacctctaagtccttctataagtgtggtggaaatgtcctatgtgaaaaaaaaagctatataggagggttttttttttccattgttttccaagttttgcagattagaaatgtcccgtacaacagcactcccagtatttaatatgtatacagatcacctggggatctggttaaaatgcagatttctgattcagctgg

SEQ ID NO: 39 - DNA, 1472 bp, Homo sapiens
acatattcagcagggttagcttgtcctcccctccctcttcagcttcccagacactgagtctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactggtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagagctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcattacggaacctgtggatgtgcctacgtttctgaaggctgctctggagaataaactgccagtagtagaaaaattcttgtcagacaagaacaatccagatgtttgtgatgagtataaacggacagctcttcatagagcatgcttggaaggacatttggcaattgtggagaagttaatggaagctggagcccagatcgaattccgtgatatggtaaatatatttctttgcttgggaatgagccaaaagaagtagactatatgaagctccggaaaacctccaatgcaaaaccgagctgattggattgaaaattgatctgagagaactaggcaaaagctcatttctccaaataaaggaaagttgggagatgagagtaggtcatgtgaaaatattttccatacatactgaaaatagaggaatatttcagggaaaagaaggaagtgaaagctgttaaactgaattcaatatcctcatcagcgagttagtcattcattttcgacacttgcctttcaacagccttgtccctccattgttcacagggcagcctgcttatggttggctgccagcaacatatacgaattctctagctgcacactttatatgatagatgccaattgctaccaatgagatttggggctagactgcatatgaaatgaattgcatctatggaaagtagctgctattcagacctcaataattcaatcactgtgatttctacgaagaccagtatgcagcataatttatgaactgaagattgagctgggaaaattctttatgtatttaaatgcagctcattttgactttatagcaaagcggcaacgggatatcaaagaaatccaagggacttggccaaaattgaatccaaaacataaacacattgaaaa

SEQ ID NO: 40 - DNA, 1387 bp, Homo sapiens
acatattcagcagggttagcttgtcctcccctccctcttcagcttcccagacactgagtctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactggtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagagctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcattacggaacctgtggatgtgcctacgtttctgaaggctgctctggagaataaactgccagtagtagaaaaattcttgtcagacaagaacaatccagatgtttgtgatgaggtaagactcatgcaaagcactgcaaaatccagctcattaattttatgtttcttatgctttactccagtcttgctaatatagtgccaaagtccttccacctgaaacagtttccccagctgttgctgtgtatgccaggagcctaataggagagttcagtggtccaaaaaataaatagatattagatcagtgatacggattgcattgttttttgcactcatatacatctggctgatttttcagtttttctttaacttcttagattcttgggataagacttttaatgtgggccaaaaagtcacctttagagatatattattagcatcatctttgattaaaaccaagcacgtcaacactagataagaaatctggagattggagttcaggggccagttgtaccactacttggctatttggttttgagcagctaatttgcatcctctgggctgtggtttccttatctgtaaacatggggcattggagtgaaataacgcctaaagttgttccagctctaatagttcattagcccattcaaataaagccaatttatcagaaatcactaatctttttgtattctttcccccatgaagtgaaattggggaccgcttctgaagttgaactaaaaacatgtctcccattctcctaaaaatgaatggaaactttttgatagtctagcaacagtcccaga

SEQ ID NO: 41 - DNA, 1877 bp, Homo sapiens
acatattcagcagggttagcttgtcctcccctccctcttcagcttcccagacactgagtctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactggtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagagctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcattacggaacctgtggatgtgcctacgtttctgaaggctgctctggagaataaactgccagtagtagaaaaattcttgtcagacaagaacaatccagatgtttgtgatgagcttgaatccacagccatccactgggcaagccgtggaggaaacctggatgttttaaaattgttgctgaataaaggagcaaaaattagcgcccgagataagttgctcagcacagcgctgcatgtggcggtgaggactggccactatgagtgcgcggagcatcttatcgcctgtgaggcagacctcaacgccaaagacagagaaggagataccccgttgcatgatgcggtgagactgaaccgctataagatgatccgactcctgattatgtatggcgcggatctcaacatcaagaactgtgctgggaagacgccgatggatctggtgctacactggcagaatggaaccaaagcaatattcgacagcctcagagagaactcctacaagacctctcgcatagctacattctgaggcaaacgacagactcttaatcagtaaatgttcactggcattttgaaggcatggcccaagagaagagacactagccataaaatctagtttctatttatcaacgtgttgtgaagatgtacctaatgaagttttgagaaagcacagggttataggtgtttaaatttcctttagtgaaactcttatttatttttatgtattcctgtttatttatttactgccacgctactgatattcagaccttcatgatcatccatctggtgagcagagcttcatttgtatataacactttcagagccttcccacccataggtagttcttaaaccaggtgaaagagcaaagttcaagtgcctacttatgtgtcattcgctcatgtaagagtttttaagagagggctgattatcacagccctcttttctcctgaatttttaatgcagaagtttgaatgaagcaagggaaggcatgtagggacaggaaaggaaacaatggaaggaaagtgattctgtgaaaaggacagtgaagccagctattttacccccaggctggattttttttttttttttttttttttttttttaccgagtacacagagtacccaagtgaagagaacgtcatgagtgtaagtgcaaatcagtggaaggagcggcaaactgggacatgcagaattgaatttgctcaaaaaagatgaaaggaaatgcaaactgtaaatgtataaatgtatattgtattgtatgtacattttatattcataataaaggcaatcaaactct

SEQ ID NO: 42 - DNA, 868 bp, Homo sapiens
agagagggggcgggtgctacctggcagctccgcgggtgcgtggccggtgctggctgggagttctggtctcaggcaaggtggggactgggcacatcatcaatacgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcagatggaatttcttctctctgttactcaagcctctcaaagtccttattgtcccagcctctgcgtgaaacgtcttcagccatcaatgacatctcactccttcaagcccttatgccactgctgggatggaccagtcactggacctgcattacagtgggcttatattgacctttacctctacacttgtatataactcgttttcccatttagttgcaagacacttggaagcacagaccaaggcttacatttgtgttttaatgtttttcttgtaaatgctttatgcctaaatgtttctgtactactcttctttccaaatccttattgtttaaaagtttctctcctactataccatgccttataaatattgattgaatgaatggatgaaatgcatacctgcttatatttctaattaaaggcaatttgggattata

SEQ ID NO: 43 - DNA, 3969 bp, Homo sapiens
agagagggggcgggtgctacctggcagctccgcgggtgcgtggccggtgctggctgggagttctggtctcaggcaaggtggggactgggcacatcatcaatacgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttagcatcctattttcattggtggtgatgctgtatgtcatctgggtccaggcagtggctgacatggaaagctaccgaaacatgaaaatgaaggactgcctggatttcaccccttctgttctgtatggctggtcatttttcctggccccagctgggatatttttttctttgctagctggattactatttctggttgttggacggcatattcagatacatcactaaatcaactgttgccacaagtattttcttgagagattttaaaacaaggaatactttttttccattttgtttcattgatcccagcataaagttagtagatataactttttagttgctattcaaattaatcattttactaaaattttcttcagtaagaaggtcctagaatctctccagacaccagcaagcctctatcttgtctaagtgctgtcaaggacctagttctttagggaataggtaaacaggtctccctttcattgaacatgttagagttcatgcaggtcgcaaaggcctgataatagcttaataccatgacatggggaaaatctcgatagatttggcttaaagtctccttggcattcacttctgctaattaaaaaaaatccttgaagaataattaagaatgggcaaggttgtcagagaatttattttgtttcttgcccacacagataatatccacatacacattcactggctcttgtgagcaaatgaatttaaaaatagacagcagttgttctaattagtgggagccatgtactcaccagttaaaatgggccacaacaaacaagactgagagcatgtacttatcttgctttttcaccaacagtggtttggttacctagttttattcacttaattgtgcatgcttacataaactttaaactacatttaaaactagcaaatctgcataccaaattatgtataacgtagattgaatttttatgaacttaaagtgagttaattgtataatgtaatattgtttaaaatatgtaaaaaccaagcatttccgcttggtccataattctatttgatattttaaaattctcatttaaaaattatattgctatcattcagcatgtgaaaatttattgataaaatgtgattttaatattttttagatataaactttcaacgtacttccatatgaggattataatagccctgctttattaaagaccataaaatattaactttccccaagatgttatgggttccagttcttctgatcatttgattcctttaattactgtccctcaatttcttcatctttacaatagatatattaacatttacagatcgactatttcctttaacctcctagaagaaagtttttgtggggaaagatgattctgtattattcagtagcatagacattttgcatatcaaagatgttcatttggcactaatgttgattgaaatcaaatccatctgagatgcctagctcgtatttgcattctggaagcctccatcgcaggggagctcggcagggtatgtgagctttgttggaggtgcggtgtttcattctgcagctgttgtgaggacagagaggcatggcccacaggcaaaaaaagtcaccacccagaagatgctctgggatagaggaactgctccttttcatcagctcttccaatgccgtgggagaggtgatcccagtcttctctgtacatcttgtgcttttccattaagacttgttccagtgggaaggagctttggaaaaattgcaaaggtctgaatcttcagggcattttcatgacaggacttgccaataataataataataataataataataataataataataaagctccagaggcctaactggtttctcaagtcatttcagtgatatcattgaaacgtttttgtggtacttccctttgtctttcactgtttcatttttatattgcttcatttacttctttgcttttggctttgttattagaaaaaataattatgaggtctgttgtgcatgttgactgtgatattaagttatggcatgccattaagttttccagacgatgttggatgtatctgattagttcatgtcatctgtaaatacaattcttttttgtagtactttggaatggagcctttttctggtgtactgtatgccatttaagtttcacatacaagctgctttcggcaaaggcttgaatatttataaatttcagatggttatcctcactttatagtacacttaagtggctaccatatattttttatatgacaattggctgaatagctgatgtgtatgacacttttacacagatttgcactttggaactattttatagttgtaatgcatcaatcaaatacatttcaagcacatttcttgatcaatttaccagcaaccctctgaaggaatgaaggagagttgtgattgctatgtcaatgagtgaaatatacttaaaaatggcagagttatatagtacattattgtagcaaccttatatctgatttgagatactgtgttgccaaatgtccatgttatgtttatttctctattggttgtatttattaatttttagaagcctttaaactgtgttagaatctttttgaaaaatgttgattttgcatcataaagtttcaatttatcaaggatatcttttcagttacacttttagaaagagtgaataaaaagggcagtgagttatgctcttggacttggtgaaagctatcatctctccatattgtatttgttcagctggtttaattcactcaggtggatgattgcacatacattggaattggctggagagactacacagagaagtttaatgatcgtgtacaatttgagggttgatggtagggctttctaaaaaaagtaatatcaagtgtgttgttagtattcatttagtcatttttattactaatctataaatatatttattaaatttgaagattaaatggaattataaaggaatatattggaggaagtgtcagtgttggtaattattcatctatttatctgtctatcatcaatatatatgggtgcatgtctgtgtatatttgtgtgtatgtaagtgtgcatgtgtattatatgtttgggtagaaagagatacattgaatggtataaatcaatatatttgagctaagcaagttaaaaaaaaatcagttatctttgggaacagcaatctattattgttgtttccctgagtgccactttaactgtttcactcaatggatggtggtttattcagttcaacacgtaatttgatttctattttcttaaaagtaaccatgttggacttacaaagagacttagaatgtcagaggtgttaggcagatattggataccagtaaaattggctggatatgtctgaaggtcggtggaattgtgagaaagaccaatggtgatggggttacattgaagaaaatataagatgagctaaatcaaaaccagatttgatttttttgggactccaccagaagtggaaactcataaacaagagatgaaacagaaaactacatttttattgattgtatgaaggagttaaatatatggagacatttcctcagtgatgatcaagggtaggtggggaaattccaataagaatgtaggatgacaataccttagatatgttgaaaaccaaggaggatggggatatagtatctttcgtattataataagcataaagttagcaaagggacatttaatttggttagc

SEQ ID NO: 44 - DNA, 978 bp, Homo sapiens
agagagggggcgggtgctacctggcagctccgcgggtgcgtggccggtgctggctgggagttctggtctcaggcaaggtggggactgggcacatcatcaatacgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcaggaatctagaagatggggggatggaagtgaagtggaatgtaaaaacgtctgccagtgccccatggtctccaacccactttcagatgcaccgtctcatttcaacagatatagatggaatttcttctctctgttactcaagcctctcaaagtccttattgtcccagcctctgcgtgaaacgtcttcagccatcaatgacatctcactccttcaagcccttatgccactgctgggatggaccagtcactggacctgcattacagtgggcttatattgacctttacctctacacttgtatataactcgttttcccatttagttgcaagacacttggaagcacagaccaaggcttacatttgtgttttaatgtttttcttgtaaatgctttatgcctaaatgtttctgtactactcttctttccaaatccttattgtttaaaagtttctctcctactataccatgccttataaatattgattgaatgaatggatgaaatgcatacctgcttatatttctaattaaaggcaatttgggattata

SEQ ID NO: 45 - DNA, 708 bp, Homo sapiens
agagagggggcgggtgctacctggcagctccgcgggtgcgtggccggtgctggctgggagttctggtctcaggcaaggtggggactgggcacatcatcaatacgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttagtcttctttgattcctcatggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacacttcatgctaaaaactctcaataaattaggtattgacgggatgtatctcaaaataataagagctatctatgacaaacccacagccaatatcatactgaatgggcaaaaactggaagcattccctttgaaaactggcaaaagacagggatgccctctctcaccactcctattcaacatagtgttggaagttctgg

SEQ ID NO: 46 - DNA, 783 bp, Homo sapiens
agagagggggcgggtgctacctggcagctccgcgggtgcgtggccggtgctggctgggagttctggtctcaggcaaggtggggactgggcacatcatcaatacgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcagtttctgtgggtcaagagtgtggaagtggctaagcagaatgagtccagctcagaatcccatgagtctgctaatcaagctattttctggggttgcaatcatctgaaggcccagctggggctaaagaacgcactttgcagctcgctttttgcctggctcagaagatccatttccagactcacttacactggcaggcctcagttccttgccatgtgaatcactgggatgggctgcctggacctcctcaggatacagcaattgctaataaaagaggtttaaggggaaccagagaactagacgataaaagaagttggctaacatgaaagccccacctccaacattggg

SEQ ID NO: 47 - DNA, 730 bp, Homo sapiens
agagagggggcgggtgctacctggcagctccgcgggtgcgtggccggtgctggctgggagttctggtctcaggcaaggtggggactgggcacatcatcaatacgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttaatggaatttcttctctctgttactcaagcctctcaaagtccttattgtcccagcctctgcgtgaaacgtcttcagccatcaatgacatctcactccttcaagcccttatgccactgctgggatggaccagtcactggacctgcattacagtgggcttatattgacctttacctctacacttgtatataactcgttttcccatttagttgcaagacacttggaagcacagaccaaggcttacatttgtgttttaatgtttttcttgtaaatgctttatgcctaaatgtttctgtactactcttctttccaaatccttattgtttaaaagtttctctcctactataccatgccttataaatattgattgaatgaatggatgaaatgcatacctgcttatatttctaattaaaggcaatttgggattata

SEQ ID NO: 48 - DNA, 1193 bp, Homo sapiens
gaatctgccggtggggcgtgagcgagaagccaccaaaacatgagctaggacagccttctcaagaagattctgccaactcaaaaatattattcttttttttttttttttgctgttgtttctgagaaactaggtgtcttaccattttaaaatttcatattttatttaaaaggaaaccagtgaattgaaaatgagactaaatatcgctatcttctttggagctctctttggtgctttgggggtgttactctttttggtggcttttggatcggattattggcttcttgcaactgaagtggggagatgttcaggtgaaaagaatatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcaggaatctagaagatggggggatggaagtgaagtggaatgtaaaaacgtctgccagtgccccatggtctccaacccactttcagatgcaccgtctcatttcaacagatatagatggaatttcttctctctgttactcaagcctctcaaagtccttattgtcccagcctctgcgtgaaacgtcttcagccatcaatgacatctcactccttcaagcccttatgccactgctgggatggaccagtcactggacctgcattacagtgggcttatattgacctttacctctacacttgtatataactcgttttcccatttagttgcaagacacttggaagcacagaccaaggcttacatttgtgttttaatgtttttcttgtaaatgctttatgcctaaatgtttctgtactactcttctttccaaatccttattgtttaaaagtttctctcctactataccatgccttataaatattgattgaatgaatggatgaaatgcatacctgcttatatttctaattaaaggcaatttgggattata

SEQ ID NO: 49 - DNA, 998 bp, Homo sapiens
gaatctgccggtggggcgtgagcgagaagccaccaaaacatgagctaggacagccttctcaagaagattctgccaactcaaaaatattattcttttttttttttttttgctgttgtttctgagaaactaggtgtcttaccattttaaaatttcatattttatttaaaaggaaaccagtgaattgaaaatgagactaaatatcgctatcttctttggagctctctttggtgctttgggggtgttactctttttggtggcttttggatcggattattggcttcttgcaactgaagtggggagatgttcaggtgaaaagaatatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcagtttctgtgggtcaagagtgtggaagtggctaagcagaatgagtccagctcagaatcccatgagtctgctaatcaagctattttctggggttgcaatcatctgaaggcccagctggggctaaagaacgcactttgcagctcgctttttgcctggctcagaagatccatttccagactcacttacactggcaggcctcagttccttgccatgtgaatcactgggatgggctgcctggacctcctcaggatacagcaattgctaataaaagaggtttaaggggaaccagagaactagacgataaaagaagttggctaacatgaaagccccacctccaacattggg

SEQ ID NO: 50 - DNA, 1083 bp, Homo sapiens
gaatctgccggtggggcgtgagcgagaagccaccaaaacatgagctaggacagccttctcaagaagattctgccaactcaaaaatattattcttttttttttttttttgctgttgtttctgagaaactaggtgtcttaccattttaaaatttcatattttatttaaaaggaaaccagtgaattgaaaatgagactaaatatcgctatcttctttggagctctctttggtgctttgggggtgttactctttttggtggcttttggatcggattattggcttcttgcaactgaagtggggagatgttcaggtgaaaagaatatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcagatggaatttcttctctctgttactcaagcctctcaaagtccttattgtcccagcctctgcgtgaaacgtcttcagccatcaatgacatctcactccttcaagcccttatgccactgctgggatggaccagtcactggacctgcattacagtgggcttatattgacctttacctctacacttgtatataactcgttttcccatttagttgcaagacacttggaagcacagaccaaggcttacatttgtgttttaatgtttttcttgtaaatgctttatgcctaaatgtttctgtactactcttctttccaaatccttattgtttaaaagtttctctcctactataccatgccttataaatattgattgaatgaatggatgaaatgcatacctgcttatatttctaattaaaggcaatttgggattata

SEQ ID NO: 51 - DNA, 8921 bp, Homo sapiens
gaggacagatagagagactcctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaagtggtggccgcctacaggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggcgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggccgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccaggtgcggcggacgccagacaccgggagtagatgtggaagtttcttctctggccccactgccccgccctcacagggctcctctcacctcctccttgagatgctgttggtagatttaacgttcttctcacgctctgcagtcagtttgacttgagtctatgagtttttccagcaaatgaagaatctacttctacttcctgaaaactcttctaactagtctttccccaggtttctttctttctttttttttttttttaataactctaagtgctaccatgaagacttcagaacagttcaaagaatccttccaccttcgactgtggggataagagtcaggggaggggaaaagacccggaaatcttccatagaacttctggcacacaaagagaaggccacagagaaagaggaccctagaatgctctaaaacctccacttgcatagctgagagctgtgcccttggcccgttattttcagtgtacctgggaagaaaaggccaaggagacgagggtgtcagtccatttgatagatggataccagaggcacaagaaagaggttacagatacagaaccacagagtgatttgtggacagaagtagaaatggcatcctggcacatacaatgataaagagataggaatgatcgagtgacgttggagccagtgatcccgatgcctgaattctggcccagtacaatatattagaatgtagaataatctggattatgataatacccccttctttctgcattctttttctggtcaagaactactggccaagagaacctatgtaagtccaggttggagctttatccaccatactggagctggaacagacctggtgcttttatattaccacattagggaattccattaggttctgagcccctccccctacttctagctttatgacttcagccttcattgctctgtggatccctgactgacaaccttgcattgcccctttgacctacgatagagtcagagaatcttccccaccacctctttgacctggatcattgcagggaggggcagcaaaggcaaggggagaagagtaaaatgatggaggagggaaaggtgattgcatttgctccccctccaaaccagcttctcccaccctcccacccccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactctgcctgagcccatctgtccttcctgccagctgtccatcctggatcagggcagtagggggcctgagaggagggaggcccccagcccctgtatcagagctgccagagccaaggcatcccatatccacaaggaaggagaccgaggtgcagaggagtgaggtgttctgcctgacgtggacagctgtgagtcccagttctgctcagtcaaccacacaagggtggagagggagaaatttcaaaagtgaagaaaacaatggcatcaaaatggtgagccagtccaagatgctacgagatagaattttggtgccgaagttgaagccactctccacctaccccacccctgaggctgcaatgattaaaggtgtcctaggacacccattctttctgaaatgaattttccaccaatgccagaaaaggctcagagctggctgagaattaaggtatgggaaaggagatgggagagattccattctagtcagcccctaggaagtaactcccagggagccccctccctgtcttccccaggggtctccccctgcctcctatgattcagcacctcaccgtgagggcatcttgagactctggggccaatcaacactgagcccaaaccaatatgccatgaggaccaagcctgggcattgctcatttcatgttggttctcacacagacacagatggcacaggtgcctgtacagggaaacactgtggtcacatttctgctctctctaagctcctactggggacagtctggcctggatcacacagctgcttgtgggacaggcccggtcctgaccccgttctgcacaaagcaaatccccactccccactgggctttgcagccaggctctgctgaccgcctccttaaccgttcacctggcaccccatctccctgactccccaagtggagcctcttctatccctcctctgagaccatgagaatggactgtgcataaagccctgagaaatgtgagcagtgaccagagaaacacaaaatcctgttggttctagcccaggagaggctgccagttctgatggtgagccaggacacaaggataggagaacaggaagcaggaggcaggaaaaagaccaagagagaggagtggctgccaccaaggaagcagagcgctctgaccagagttcaagatccagggttcgggcaggacttgggagctggggcctgcagctggaaggagcgctccagaagaaggattgtatctcagggcgggaacacacacacatcagcgacaggagatagcacgtcagctgggatggagctgctgagccaggccatgctgggctcctcgggctgggcaggaacgtctggctgcacatctgtctgtctcggcccagcagggctgactcccgggctgtggcagtgtctgctccaaactcccctgggccttcccatagcattcactgtggggagctcttgaccagcttgtctctttcccagcctgtgagtgctaaagggcaggccccccgtcacctctgaggccctggcacccagcacagtgtgcatgggagatgctcaggaaatgtgtgctgaggagctggcaagctgggagggtggacccgcagtggagggaagagttggccattcttttctgagctacaaggaggctcagtacagtatccagaacactcgcttaggtgtcagaagagctgcgttctggccctagctctgtcacaaatgagttcacctcccctggctgggcctgttttctcttatgtgaaatgagggcattggaccagctgataatcaacggctctcccagcattcgcattttgggaaatctctccctcctctgatacctcaggctgccctctccctgcctcctgttcctgtcatag

SEQ ID NO: 52 - DNA, 6290 bp, Homo sapiens
gaggacagatagagagactcctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaagtggtggccgcctacaggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggcgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggtgaggcccagtggggagggtgggcaggcttgatggcagccctggggcaattcatctcagtgccagaaatggagcctggagctggaaagagtcctctgcaagggaaagaccctccagtctaggttctgccctgcagctaagcgtcatttaatgcctcttttcttattcgtaaggggatggggtgagcagactgggaaactcctcaaacagtgaggtgccacatcagcccacatggtgaataaggctgggcttggttgaagtactacataagaagagaatctagagaatggggcacagggagtccctcccacctcctggtgcccccccccctccccaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggccgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactc

SEQ ID NO: 53 - DNA, 6057 bp, Homo sapiens
gaggacagatagagagactcctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaagtggtggccgcctacaggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggcgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcagggtgtgctgggggtccaagaggccagagatgagttggtgggagggagggccatgcaggggcagggggaacataggctttgagctttctggccctctggtccccagaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggccgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactc

SEQ ID NO: 54 - DNA, 6177 bp, Homo sapiens
gaggacagatagagagactcctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaagtggtggccgcctacaggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggcgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggccgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccaggtgcggcggacgccagacaccgggagtagatgtggaagtttcttctctggccccactgccccgccctcacagggctcctctcacctcctccttgagatgctgttggtagatttaacgttcttctcacgctctgcagtcagtttgacttgagtctatgagtttttccagcaaatgaagaatctacttctacttcctgaaaactcttctaactagtctttccccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactc

SEQ ID NO: 55 - DNA, 9119 bp, Homo sapiens
gaggacagatagagagactcctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaagtggtggccgcctacaggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggcgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggccgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgtaagtgaccgcccaccttccgcctcccctaaagacagaaacaaggccttgggtccaggccaggccactgtgctgtaacaccaagccaactctgcagttctgtggatttgagggcctgatgggagaaaggagatccttggggggcaaaaggccccggcccctggcccatgttccttgccacctctctcctgcacacaggccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccaggtgcggcggacgccagacaccgggagtagatgtggaagtttcttctctggccccactgccccgccctcacagggctcctctcacctcctccttgagatgctgttggtagatttaacgttcttctcacgctctgcagtcagtttgacttgagtctatgagtttttccagcaaatgaagaatctacttctacttcctgaaaactcttctaactagtctttccccaggtttctttctttctttttttttttttttaataactctaagtgctaccatgaagacttcagaacagttcaaagaatccttccaccttcgactgtggggataagagtcaggggaggggaaaagacccggaaatcttccatagaacttctggcacacaaagagaaggccacagagaaagaggaccctagaatgctctaaaacctccacttgcatagctgagagctgtgcccttggcccgttattttcagtgtacctgggaagaaaaggccaaggagacgagggtgtcagtccatttgatagatggataccagaggcacaagaaagaggttacagatacagaaccacagagtgatttgtggacagaagtagaaatggcatcctggcacatacaatgataaagagataggaatgatcgagtgacgttggagccagtgatcccgatgcctgaattctggcccagtacaatatattagaatgtagaataatctggattatgataatacccccttctttctgcattctttttctggtcaagaactactggccaagagaacctatgtaagtccaggttggagctttatccaccatactggagctggaacagacctggtgcttttatattaccacattagggaattccattaggttctgagcccctccccctacttctagctttatgacttcagccttcattgctctgtggatccctgactgacaaccttgcattgcccctttgacctacgatagagtcagagaatcttccccaccacctctttgacctggatcattgcagggaggggcagcaaaggcaaggggagaagagtaaaatgatggaggagggaaaggtgattgcatttgctccccctccaaaccagcttctcccaccctcccacccccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactctgcctgagcccatctgtccttcctgccagctgtccatcctggatcagggcagtagggggcctgagaggagggaggcccccagcccctgtatcagagctgccagagccaaggcatcccatatccacaaggaaggagaccgaggtgcagaggagtgaggtgttctgcctgacgtggacagctgtgagtcccagttctgctcagtcaaccacacaagggtggagagggagaaatttcaaaagtgaagaaaacaatggcatcaaaatggtgagccagtccaagatgctacgagatagaattttggtgccgaagttgaagccactctccacctaccccacccctgaggctgcaatgattaaaggtgtcctaggacacccattctttctgaaatgaattttccaccaatgccagaaaaggctcagagctggctgagaattaaggtatgggaaaggagatgggagagattccattctagtcagcccctaggaagtaactcccagggagccccctccctgtcttccccaggggtctccccctgcctcctatgattcagcacctcaccgtgagggcatcttgagactctggggccaatcaacactgagcccaaaccaatatgccatgaggaccaagcctgggcattgctcatttcatgttggttctcacacagacacagatggcacaggtgcctgtacagggaaacactgtggtcacatttctgctctctctaagctcctactggggacagtctggcctggatcacacagctgcttgtgggacaggcccggtcctgaccccgttctgcacaaagcaaatccccactccccactgggctttgcagccaggctctgctgaccgcctccttaaccgttcacctggcaccccatctccctgactccccaagtggagcctcttctatccctcctctgagaccatgagaatggactgtgcataaagccctgagaaatgtgagcagtgaccagagaaacacaaaatcctgttggttctagcccaggagaggctgccagttctgatggtgagccaggacacaaggataggagaacaggaagcaggaggcaggaaaaagaccaagagagaggagtggctgccaccaaggaagcagagcgctctgaccagagttcaagatccagggttcgggcaggacttgggagctggggcctgcagctggaaggagcgctccagaagaaggattgtatctcagggcgggaacacacacacatcagcgacaggagatagcacgtcagctgggatggagctgctgagccaggccatgctgggctcctcgggctgggcaggaacgtctggctgcacatctgtctgtctcggcccagcagggctgactcccgggctgtggcagtgtctgctccaaactcccctgggccttcccatagcattcactgtggggagctcttgaccagcttgtctctttcccagcctgtgagtgctaaagggcaggccccccgtcacctctgaggccctggcacccagcacagtgtgcatgggagatgctcaggaaatgtgtgctgaggagctggcaagctgggagggtggacccgcagtggagggaagagttggccattcttttctgagctacaaggaggctcagtacagtatccagaacactcgcttaggtgtcagaagagctgcgttctggccctagctctgtcacaaatgagttcacctcccctggctgggcctgttttctcttatgtgaaatgagggcattggaccagctgataatcaacggctctcccagcattcgcattttgggaaatctctccctcctctgatacctcaggctgccctctccctgcctcctgttcctgtcatag

SEQ ID NO: 56 - DNA, 5395 bp, Homo sapiens
cctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggcgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggccgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactc

SEQ ID NO: 57 - DNA, 4427 bp, Homo sapiens
gtaccagcacagcgccccttcagcaggccagcgctactggctccagattccttttcctgtcagggtatgggactgtggaagcctgggagtgtgctcagtgattctctctttgcctcttcaccctgccctcagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggcgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggccgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactc

SEQ ID NO: 58 - DNA, 2533 bp, Homo sapiens
gcacgcatcgaggagctggaggaggagctggaggccgagcgcaccgccaggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggccgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactc

SEQ ID NO: 59 - DNA, 2477 bp, Homo sapiens
gaggacagatagagagactcctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaagtggtggccgcctacaggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaaggtgcctccttggcctcaccacctatgccccctcctctgccatccagacaaagtggtggctgagtcccttctacacccaagaaactagagtcccaagaatcccaggcctttctccaggcccagcttctccccactgtgaagtcatgggcatgaacaggatgatccccccactcttcctttcccaggaccttgcactttatgcccctttgtggtggtcccctcagtgtcttaagagtgagatgtagtgaaggagaggcccctggcccctctgaccgcccatgagaagcgtcattcatggaaagatcctaggctgaaattagagatgtttggcctcccaccaccttcctgttggttgagaaataagccagtctccagccctcttgcttatgggcattcctcagaagagacaaggccgcaggcgggaggccccataggccggggctgacttgctctcagtgaacctctgctctttgtcagcataggccagagcccggattgtctgacccacacccagcccagccacggccttcatgaaatgggagcttccccacatgctttgggtcattatccagattcttaaccagagttctcatgtttcagagccctcagaatgccataaaactgtgtgtggaaaaaagcatgtgtacattcatacatacatgtgtgtgcttgtgcatgtgtgtgtgtgtacgtgtgtgtgtgtacatgcgtttttctggagagacagtctttagcttcaacaaattcttaaaaggattcctgccccaagaaaaatcaagaaccaccaggtttttggaagtgcagagtgtggtaaagaacc

SEQ ID NO: 60 - DNA, 6903 bp, Homo sapiens
gaggacagatagagagactcctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaagtggtggccgcctacaggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgaccccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggcgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggccgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccaggtgcggcggacgccagacaccgggagtagatgtggaagtttcttctctggccccactgccccgccctcacagggctcctctcacctcctccttgagatgctgttggtagatttaacgttcttctcacgctctgcagtcagtttgacttgagtctatgagtttttccagcaaatgaagaatctacttctacttcctgaaaactcttctaactagtctttccccaggtttctttctttctttttttttttttttaataactctaagtgctaccatgaagacttcagaacagttcaaagaatccttccaccttcgactgtggggataagagtcaggggaggggaaaagacccggaaatcttccatagaacttctggcacacaaagagaaggccacagagaaagaggaccctagaatgctctaaaacctccacttgcatagctgagagctgtgcccttggcccgttattttcagtgtacctgggaagaaaaggccaaggagacgagggtgtcagtccatttgatagatggataccagaggcacaagaaagaggttacagatacagaaccacagagtgatttgtggacagaagtagaaatggcatcctggcacatacaatgataaagagataggaatgatcgagtgacgttggagccagtgatcccgatgcctgaattctggcccagtacaatatattagaatgtagaataatctggattatgataatacccccttctttctgcattctttttctggtcaagaactactggccaagagaacctatgtaagtccaggttggagctttatccaccatactggagctggaacagacctggtgcttttatattaccacattagggaattccattaggttctgagcccctccccctacttctagctttatgacttcagccttcattgctctgtggatccctgactgacaaccttgcattgcccctttgacctacgatagagtcagagaatcttccccaccacctctttgacctggatcattgcagggaggggcagcaaaggcaaggggagaagagtaaaatgatggaggagggaaaggtgattgcatttgctccccctccaaaccagcttctcccaccctcccacccccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactc

SEQ ID NO: 61 - DNA, 22 bp, Homo sapiens
tcccctgagagctgtagaagct

SEQ ID NO: 62 - DNA, 19 bp, Homo sapiens
cggcctgtgtgagtccaaa

SEQ ID NO: 63 - DNA, 101 bp, Homo sapiens
tcccctgagagctgtagaagctgggacaagagagtggttgtgggtcagggtggtatcaggtgggaattttctgtgtagtggctttggactcacacaggccg

SEQ ID NO: 64 - DNA, 20 bp, Artificial
  Synthetic oligonucleotide
ttccttggcatctccaatgg

SEQ ID NO: 65 - DNA, 997 bp, Artificial
  Synthetic oligonucleotide
tctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgagctctgaagcccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcg

SEQ ID NO: 66 - DNA, 838 bp, Artificial
  Synthetic oligonucleotide
gtaagatgggcaactttggagctatatctgattggttattactactgctctttcagccaagcctgttctaaaaagccaagtcctcccctgagagctgtagaagctgggacaagagagtggttgtgggtcagggtggtatcaggtgggaattttctgtgtagtggctttggactcacacaggccggaactcaaatcttaccttataggctacatgactgtgggcaaatcaccttttccaagtgcaactgtaaaacgggtattaataataccaaccttgtagggctgctgggaagcctgtaagagacagtgtatgcacagcacaaagcatcactgattgaggaacacagcaggtgctccatgtcctttgtttgctcttcctgtgtttctaccttgcctcacctcaggaagaagtagaaaacagggccaaatctgatcccaggccctctaggaggggctcccattgcctatctcagcattccctttcctctcctccctaggactgcattgtcacttgcagggacaggctcgtgactggtggggacactgaatgacagtacagtcctttcttccccattctagtcctaccccattttcatgctttctatgtctggcctactgaaactacttgactactgcttgggtaggaagtaccacagccaggctggcagatctgttcaagcttggggacttcacttggagaatctagccttgactgaattccccccagacccagggagagcagccaactgtggattctgcctaaccacagggcctcaggttttcacctaggcatcttcactgcacaccttcttgggtcagcataacctgttaactgcat

SEQ ID NO: 67 - DNA, 2226 bp, Artificial
  Synthetic oligonucleotide
acactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgtaagttacccaggaagaaggattataggaaaaataactcagtaagtttaaaaccaaacacatttccatttagtgacaggaatttaagcaaggacctgaagtagaatcaactgattcacacagtagtaaatacaaagtagaacaatgatcttggcttcgctgtctggttcagtggtctgctggaatgcaatacacaagttaagtcacactgcagactgttttctagctgtggccgctggatgccacttctagcatagtagaactatgttaggaggaatgggaaaagtgagcaccacttctcaccatgttcccccctcctgctgccagtctctgctcccatgttggatgcagcagagatcacccaccagttggcccaggacagaccaataggaagggtccaatcactctaactacagccgaactcacctccacaacagtctctgtggctctagcctggactcctttacaggaatccagctctggcagtggcagctggagagggtaatagggcctcctgctgaatgaaggaagttgggtgaatgaatgggtgagctgcagggttcacttgcaaagggaccaggagtgataaggaaacaacaactcattcaggcagctgcttttgacctctaactcccaaacctgcctgttgcatgaggggaagccatctcccatgggagcgaagttaatggggtgggaggctatattctcactattgagtctttccaggagtctcaaggcacaaggctcctggtttcttactctcaaccaccccctacactctttatactctcactccttgtgcttcttcttgtgcttcttcttctttttcttcttctttgctgccttgctgtcttttgatgtgtgccttgccctcttgcctgtatcactctcagagtctgagctgtcagagtcagatgacttcctatctctatgtttctttttcttcttctcctgaaaagaaaattttaaaaatcaacactgtatgtgtatatttgcttttaacaatcatagcacataattggccaggtgcagtggctcacacctgtaatcctagtactttgggaagccgaggtgggaggaatgcttgaggccaggagttcaagatcaacctggctaacatagcaagatctcatctctaaaaagagaaaaaaagaaaaattatagcacacaatcaataggggaccacttaattttcttttagacagtctcgctctgttgcccaggctagagtgcagtgcagtggcacgatcacagctcactgcaacctca

SEQ ID NO: 68 - DNA, 461 bp, Artificial
  Synthetic oligonucleotide
gatgttctgacagcctggccaagcatctacaggagacaagtcaaagttttaagagaagatgaaataacaattcttccttggcatctccaatggagtagagagaaggcaacaaagcttctcagacccacattaccgagctataacaaccatggctgggaggagctgagagttggcaaatcaatagtttagctatgttgctgaaccttcctggatggcaagaccatggaagtccatcacaagatattatggggtcaggagcctcactgggttctgccccttatataggtgaatatcctgggaaagtaaaaatgaaaatacagagtctggcaccagttccctgcaagcctggtccagcctggataaagaagtgaggagagtaataatactgccttacacctaaacagtgctttagtttatcaagctttttgcatccttatcttacaataatagtctgtagagtc

SEQ ID NO: 69 - DNA, 550 bp, Artificial
  Synthetic oligonucleotide
atggaaaaactgcaactcagaaatgtaaagtgagtcgaccaaggctaaagcggcaaaaccactatactttataacacagagtttggcactatttccactttgttctctctcaaagatgaaggctcaggaggagggaagataaaaacaaatcactggagagtcctggcatgctggaacatggactctagctagcaagaagggctcaaggaggtggccttctcctagacctcaactttgatgcaaaagctgttttgcagcctgaacaaagacaatccaatcctccagcaaatggcgtcattttccctacgtgtctagccttgagctacagaacaaaagaacaatcacatccgaagttgtagttcgcctggttgcggtggctcacgcctgtgatcccagcactttgggaggccaaggtgggtggatcacctgaggtcaggaggtcgagactagcctgaccaacatgaagaaaccccatctctactaaaaatacaaaattagctgggcgtggtggcacatgcctgtaatcccagctactcgggaggctgaggca

SEQ ID NO: 70 - DNA, 173 bp, Artificial
  Synthetic oligonucleotide
gtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaag

SEQ ID NO: 71 - DNA, 102 bp, Artificial
  Synthetic oligonucleotide
tccattgtgacactggatggagggaaacttgttcacctgcagaaatgggacgggcaagagaccacacttgtgcgggagctaattgatggaaaactcatcctg

SEQ ID NO: 72 - DNA, 33 bp, Artificial
  Synthetic oligonucleotide
ctcatatactcataaccttccccctaccctcag

SEQ ID NO: 73 - DNA, 237 bp, Artificial
  Synthetic oligonucleotide
atgcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacggcatatttgggaacgagaaacaaaagttttc

SEQ ID NO: 74 - DNA, 131 bp, Artificial
  Synthetic oligonucleotide
gttgcaaagaaattatctttgaagatgaatgaggttgacttctatgagccatttatggatgagcccattgccatccccaacaaaccttacacagaagaggagctggtggagtttgtgaaggaacaccaaag

SEQ ID NO: 75 - DNA, 281 bp, Artificial
  Synthetic oligonucleotide
atcaaggaattggactcaatagttaagtaacttagccaaggatgaacactctatgcatagaacttctgggagagaaatgcttgataccacttagtgtagctccagcatggatcagcaaactttttctgtaaagaacaaaatggtaaatatttcaggttctgtgggccagatggcgtctgtagcaactacttgactgcggctgtggcatgaaagcagccatggatcatgtataaacaaatgggtgtggctgtgtaccagtaaaagtttatccggaaaaaaag

SEQ ID NO: 76 - DNA, 136 bp, Artificial
  Synthetic oligonucleotide
tctatagaataatcctataattgagggtgagcaccaaatgtcctaagaagtcctcgtggaaaaatcacactctgctctccacattagaagctgtgtatgtgcaggggttactcaactctcttgaatcctgtttcag

SEQ ID NO: 77 - DNA, 248 bp, Artificial
  Synthetic oligonucleotide
ctgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttc

SEQ ID NO: 78 - DNA, 1124 bp, Artificial
  Synthetic oligonucleotide
catctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagaggccttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttgaaaatcct

SEQ ID NO: 79 - DNA, 181 bp, Artificial
  Synthetic oligonucleotide
ggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgag

SEQ ID NO: 80 - DNA, 141 bp, Artificial
  Synthetic oligonucleotide
cactggcaaatatcccagtggtggttgcatttccaaaccccaagagaggaaggcaaaatgaagttgctggagttgagtgaatctgcagatggagctgcgtggaaacgctggggagggaatagcaacacacacaggattcag

SEQ ID NO: 81 - DNA, 33 bp, Artificial
  Synthetic oligonucleotide
taatgagacagaggctgagcagagctatgtaag

SEQ ID NO: 82 - DNA, 101 bp, Artificial
  Synthetic oligonucleotide
gttttgatgaagaaggaagcctgtatattcttaagggtgatcgcacaatagagtttgatggcgagtttgcagctgatgtcttggtggagttcctcttggat

SEQ ID NO: 83 - DNA, 112 bp, Artificial
  Synthetic oligonucleotide
ctaattgaagacccagtggagatcatcagcagcaaactggaagtccaagccttcgaacgcattgaagactacatcaaactcattggctttttcaagagtgaggactcagaat

SEQ ID NO: 84 - DNA, 74 bp, Artificial
  Synthetic oligonucleotide
actacaaggcttttgaagaagcagctgaacacttccagccttacatcaaattctttgccacctttgacaaaggg

SEQ ID NO: 85 - DNA, 95 bp, Artificial
  Synthetic oligonucleotide
gtgctgtggctcacacctgtaatcccaacactttgggaggctgacgggggtggattgcatgagccttggagttggagaccagcctgggcaacatg

SEQ ID NO: 86 - DNA, 115 bp, Artificial
  Synthetic oligonucleotide
tgcaggcaaacagcaaccattctgccttgacaacacactgaacatgtggctgctttaatccagagagaaaatgtcttcctggctatcggctggctctccgagctctttatctgtt

SEQ ID NO: 87 - DNA, 46 bp, Artificial
  Synthetic oligonucleotide
acccactctacgtcgcctgcgcccagaagaaatgtttgaaacatgg

SEQ ID NO: 88 - DNA, 55 bp, Artificial
  Synthetic oligonucleotide
gaagatgatttgaatgggatccacattgtggcctttgcagagaagagtgatccag

SEQ ID NO: 89 - DNA, 101 bp, Artificial
  Synthetic oligonucleotide
atggctacgaattcctggagatcctgaaacaggttgcccgggacaatactgacaaccccgatctgagcatcctgtggatcgacccggacgactttcctctg

SEQ ID NO: 90 - DNA, 57 bp, Artificial
  Synthetic oligonucleotide
ccaaatgaagagaactcacttgtttattgtggggatttattttctgtcctcttgcag

SEQ ID NO: 91 - DNA, 75 bp, Artificial
  Synthetic oligonucleotide
ctcgttgcctactgggagaagactttcaagattgacctattcaggccacagattggggtggtgaatgtcacagat

SEQ ID NO: 92 - DNA, 46 bp, Artificial
  Synthetic oligonucleotide
gctgacagtgtctggatggagattccagatgatgacgatcttccaa

SEQ ID NO: 93 - DNA, 10 bp, Artificial
  Synthetic oligonucleotide
ccttttccat

SEQ ID NO: 94 - DNA, 85 bp, Artificial
  Synthetic oligonucleotide
cttgtggcccaggtccttgaacataaagctataggctttgtgatggtggatgccaagaaagaagccaagcttgccaagaaactgg

SEQ ID NO: 95 - DNA, 214 bp, Artificial
  Synthetic oligonucleotide
gggggggccttcgcggtgcagctgaggctgcaagtagccggcgccgtcccgcgtcgcccccgcgcagggcgggccccgcacgcttatcctgcccgggaggaacgccggcgtccagcccgctaccgaccgccgctgcgggatgctgcgctccacgtccacggtcaccctgctctcgggcggcgccgccaggacgcccggggcgcccagcaggagg

SEQ ID NO: 96 - DNA, 133 bp, Artificial
  Synthetic oligonucleotide
tttggaaaacagcaacattaaggatcaaatcagaaatctgcagcagacgtatgaagcatccatggacaagctgagggaaaagcagaggcagttggaggtagcgcaagttgaaaaccagctgctaaaaatgaag

SEQ ID NO: 97 - DNA, 126 bp, Artificial
  Synthetic oligonucleotide
gtggaatcgtcccaagaagccaatgctgaggtgatgcgagagatgaccaagaagctgtacagccagtatgaggagaagctgcaggaagaacagaggaagcacagtgctgagaaggaggctcttttg

SEQ ID NO: 98 - DNA, 129 bp, Artificial
  Synthetic oligonucleotide
gaagaaaccaatagttttctgaaagcgattgaagaagccaataaaaagatgcaagcagcagagatcagcctagaggagaaagaccagaggatcggggagctggacaggctgattgagcgcatggaaaag

SEQ ID NO: 99 - DNA, 160 bp, Artificial
  Synthetic oligonucleotide
atcatgtcgcacgagctcttctccagatttagtctccggctctttggaagatgataagttggtagcctgctctgggttggaagcgattcctttattgttcgtgattagaagaacacttgtacactctctgctgggaagaggtggtatttatctatgatga

SEQ ID NO: 100 - DNA, 969 bp, Artificial
  Synthetic oligonucleotide
ccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaacttgtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctactaaaaaaat

SEQ ID NO: 101 - DNA, 93 bp, Artificial
  Synthetic oligonucleotide
gtgagagccactttggaaaaggtgagaaagcgaatgtatggagactatgatgagatgagacagaagattcgacagctcacccaggaactatca

SEQ ID NO: 102 - DNA, 114 bp, Artificial
  Synthetic oligonucleotide
gtttcccatgctcagcaggagtatctggagaatcacatccaaacccagtcgtctgccctggatcgttttaatgccatgaactcagccttggcatcagattccattggcctgcag

SEQ ID NO: 103 - DNA, 20 bp, Artificial
  Synthetic oligonucleotide
aaaaccctcgtggatgtgac

SEQ ID NO: 104 - DNA, 110 bp, Artificial
  Synthetic oligonucleotide
tagcagtggtgttcagggtaggatgcagttcttcgcattgtgcataacacaagccctgaaccagctgctttgggaacccctgggaataaagtgccctacctgcctttcag

SEQ ID NO: 105 - DNA, 80 bp, Artificial
  Synthetic oligonucleotide
gaacgtcatcaactgcaacttcaactcctagaacatgaaacagaaatgtctggggagttaactgattctgacaaggaaag

SEQ ID NO: 106 - DNA, 106 bp, Artificial
  Synthetic oligonucleotide
gtatcagcagttggaggaggcatcagccagcctccgtgagcggatcagacacctagatgacatggtgcattgccagcagaagaaagtcaagcagatggtcgaggag

SEQ ID NO: 107 - DNA, 84 bp, Artificial
  Synthetic oligonucleotide
attgaatcattaaagaaaaagttgcaacagaaacagctcttaatactgcagcttttagaaaagatatctttcttagaaggagag

SEQ ID NO: 108 - DNA, 85 bp, Artificial
  Synthetic oligonucleotide
gcactgccaagcctggggcatctctggagattgtgtatccgagtttcaggagaccatggagatcagcctcgtaaaatgctcggag

SEQ ID NO: 109 - DNA, 101 bp, Artificial
  Synthetic oligonucleotide
aataatgaactacaaagcaggttggactatttaacagaaacccaggccaagaccgaagtggaaaccagagagataggagtgggctgtgatcttctacccag

SEQ ID NO: 110 - DNA, 87 bp, Artificial
  Synthetic oligonucleotide
gcaaatgtttgcagactacggctgaccgtacctcctgagagtccagttcctgagcaatgtgaaaagaagattgagagaaaagagcag

SEQ ID NO: 111 - DNA, 106 bp, Artificial
  Synthetic oligonucleotide
cttcttgacctgagcaatggagaacctaccaggaaacttcctcagggtgttgtttatggtgtggtgcgaagatcagatcaaaatcagcagaaagaaatggtggtgt

SEQ ID NO: 112 - DNA, 50 bp, Artificial
  Synthetic oligonucleotide
atgggtggtccaccagtcagctgaaagaagagatgaactacatcaaagat

SEQ ID NO: 113 - DNA, 341 bp, Artificial
  Synthetic oligonucleotide
tctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgtttttttaactgttgg

SEQ ID NO: 114 - DNA, 180 bp, Artificial
  Synthetic oligonucleotide
gggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggagg

SEQ ID NO: 115 - DNA, 77 bp, Artificial
  Synthetic oligonucleotide
gttggccctgacctcgttggaaaacgaagctccccgcagggtcccggcctctagggctgctgtgcgggcgggggtgg

SEQ ID NO: 116 - DNA, 49 bp, Artificial
  Synthetic oligonucleotide
ccccaagaccaaatagcagttggggaagacggcttcaaacagtgggacg

SEQ ID NO: 117 - DNA, 67 bp, Artificial
  Synthetic oligonucleotide
tgctggagtctctggacatggaggccatgctggacaccgtgcaggcctggctgagcagcccgcagaa

SEQ ID NO: 118 - DNA, 37 bp, Artificial
  Synthetic oligonucleotide
gtttgcccgtgcccacggggtcagcgtccagccagag

SEQ ID NO: 119 - DNA, 53 bp, Artificial
  Synthetic oligonucleotide
gcctcggacacccacatcctcctcctggaaggcttcctgctctacagctacaa

SEQ ID NO: 120 - DNA, 72 bp, Artificial
  Synthetic oligonucleotide
gcccctggtggacttgtacagccgccggtacttcctgaccgtcccgtatgaagagtgcaagtggaggagaag

SEQ ID NO: 121 - DNA, 60 bp, Artificial
  Synthetic oligonucleotide
cctggagctatttccattcggcggcgggaacaggtgccggcgcctccgccccatccccag

SEQ ID NO: 122 - DNA, 91 bp, Artificial
  Synthetic oligonucleotide
catgaccaacggcggcaagaccacgctgaccaacagcctgctcagagccctgcccaactgctgcgtgatccatcaggatgacttcttcaag

SEQ ID NO: 123 - DNA, 353 bp, Artificial
  Synthetic oligonucleotide
ggttggattcctgggagcttcatcacatttggttctcagctgactttatatactaaaaaataacttcctttcgcctgaccatggagagggactgccaggggtgaaggcagccctgtctgaggccagaggtctgcccacgtggcggatgaggcaggtgtgaggccagcttgagcatctggatccatttgtctcgggctgctggctgcctgccatttcctcctctccacccttatttggaggccctgacagctgagccacaaacaaaccaggggagctgggcaccagccaagcgtcaccctctgtttccccgcacgggtaccagcgtcgaggagaaagaatcctgaggcacggcg

SEQ ID NO: 124 - DNA, 128 bp, Artificial
  Synthetic oligonucleotide
gctgcagcttcctgtcaacacttctcacatcttatgctaactgtagataaagtggtttgatggtgacttcctcgcctctcccaccccatgcattaaattttaaggtagaacctcacctgttactgaaa

SEQ ID NO: 125 - DNA, 127 bp, Artificial
  Synthetic oligonucleotide
ctgggagacagggacagacgtaggccaagagaggggaaccagagaggaaccagaggggagagacagagcagcaagcagtggattgctccttgacgacgccagcatgagctccttctccaccaccacc

SEQ ID NO: 126 - DNA, 327 bp, Artificial
  Synthetic oligonucleotide
aatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccgg

SEQ ID NO: 127 - DNA, 132 bp, Artificial
  Synthetic oligonucleotide
tactgaagataacagccagggaggacaagcagggctgggcctagggacagactgcaagaggctcctgtcccctggggtctctgctgcatttgtgtcatcttgttgccatggagttgtgatcatcccatctaa

SEQ ID NO: 128 - DNA, 11 bp, Artificial
  Synthetic oligonucleotide
gtggtttgaaa

SEQ ID NO: 129 - DNA, 35 bp, Artificial
  Synthetic oligonucleotide
gtgaataaacttcagcaccatggacagaagacaaa

SEQ ID NO: 130 - DNA, 158 bp, Artificial
  Synthetic oligonucleotide
tctcagtgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgg

SEQ ID NO: 131 - DNA, 405 bp, Artificial
  Synthetic oligonucleotide
gtgggacggggcttcctgggggcagagtacaggcgccggagggatccaagaccctgggagtggggggaggagccagggctgcgaagggggcggggactacgcggaggggcttcaggggcggagttttgcagagggtcatgctcggattggtgacagcagcctgcgggcggaactccgttgccctcggacttgcttagggatagatgggaagtgcctatccaaaggaagagacccagattggtggatgggaatgaggggcgtggcctcccgtagactcagggctcaagttggacgtgggcccaaatctggaccggctgggtttgctgggggtgtcttgaggtcccctccaccgtcgtctccgaatccccctccatgatccttccttgctccatctcaccctggcag

SEQ ID NO: 132 - DNA, 534 bp, Artificial
  Synthetic oligonucleotide
gtgggacgcatgggcagctcgggtaccttcggggtagggtgagatggctgggacttggtctctgcctgaccccttgcagctgcttttggctgcacatcccaggagacccaggacaactgtgagcctggcagggctggggcagaaggatgagtacaatatagtcaaggaaagctgttctaggcagagggaacagcacatgcaaggccatgggttgggaaacagaaaataagttagtgaacatgctcagggcatcacatgttggtaaattagctcaggcactggccagggaattgtgatttgcatgtagctggaccaggttatgccagtggttttgagaggtgaggctggagcatatgaggagggggattcagttccaggattagaagcctagactgggagcctaagccgggaagagactggtaaggcctcggtactggaagacgagataaggagaataaaaaaggagtgtaggatggaggagttgggtgtgcgggaaatggaaggagaagtacccaccccctcgtgtgcccccag

SEQ ID NO: 133 - DNA, 144 bp, Artificial
  Synthetic oligonucleotide
attgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccac

SEQ ID NO: 134 - DNA, 42 bp, Artificial
  Synthetic oligonucleotide
aaaaaatctaagatctccgcctcgagaaaattgcagctgaag

SEQ ID NO: 135 - DNA, 36 bp, Artificial
  Synthetic oligonucleotide
actctgctgctgcagattgcaaagcaagagctggag

SEQ ID NO: 136 - DNA, 44 bp, Artificial
  Synthetic oligonucleotide
cgagaggcggaggagcggcgcggagagaaggggcgcgctctgag

SEQ ID NO: 137 - DNA, 52 bp, Artificial
  Synthetic oligonucleotide
cacccgctgccagccgctggagttggccgggctgggcttcgcggagctgcag

SEQ ID NO: 138 - DNA, 36 bp, Artificial
  Synthetic oligonucleotide
gacttgtgccgacagctccacgcccgtgtggacaag

SEQ ID NO: 139 - DNA, 54 bp, Artificial
  Synthetic oligonucleotide
gtggatgaagagagatacgacatagaggcaaaagtcaccaagaacatcacggag

SEQ ID NO: 140 - DNA, 18 bp, Artificial
  Synthetic oligonucleotide
ctcaagcaggtgaagaag

SEQ ID NO: 141 - DNA, 15 bp, Artificial
  Synthetic oligonucleotide
gaggacaccgagaag

SEQ ID NO: 142 - DNA, 20 bp, Artificial
  Synthetic oligonucleotide
gaaaaccgggaggtgggaga

SEQ ID NO: 143 - DNA, 13 bp, Artificial
  Synthetic oligonucleotide
ctggcgcaagaac

SEQ ID NO: 144 - DNA, 24 bp, Artificial
  Synthetic oligonucleotide
atcgatgcactgagtggaatggag

SEQ ID NO: 145 - DNA, 94 bp, Artificial
  Synthetic oligonucleotide
ggccgcaagaaaaagtttgagagctgagccttcctgcctactgcccctgccctgaggagggccctgaggaataaagcttctctctgagctgaaa

SEQ ID NO: 146 - DNA, 13 bp, Artificial
  Synthetic oligonucleotide
gagcagcgatgcg

SEQ ID NO: 147 - DNA, 45 bp, Artificial
  Synthetic oligonucleotide
gtgagagcagcgggctaaggcgtggctgggacccccagggccagg

SEQ ID NO: 148 - DNA, 50 bp, Artificial
  Synthetic oligonucleotide
gctagggaacctcgccctgcaccagccccaatcagacgccgctcctccaa

SEQ ID NO: 149 - DNA, 34 bp, Artificial
  Synthetic oligonucleotide
ctaccgcgcttatgccacggagccgcacgccaag

SEQ ID NO: 150 - DNA, 1284 bp, Artificial
  Synthetic oligonucleotide
ttccatgctctttaaaagccttataattttctggatctgggagctgggctatttcagggtcaatggatttatttcagttggtgcctgaactgacttgaaacaagtgtgtgtggaaaagagctattttgagaaggaataaaccgagactgccctgatgatagaatatgcaagctggtgggtcttgactccttaaaggattatgaaattaatttgattggtcccaatctttatataaccaccccaatcaggaaacttcccatcccgccaaaaggccccctcacgtgctctccctgtcagtaccccatgcaaaggtaaaatagatgatatttttaaacatgggtcgtgtttaaaagaaatggaaactccttcagagaatgaaggagaaccacactgggtagaaggttattcctggggctccaccccttgctccatcaagtcctctgagcatgagctgggctctgagaaggaagagacaggaaccaattggtcatgtccacgtggcctcagaagctgagtacgtgacggtcaccagatgcctaggcaggctcccttgaaatggcagggctgctgtccaaaatcctgctgggtcattgctatttacaggcagccttcccggcgtgcggtggatatcccaagcggggctatttttaagcagggctatggcctgccgtgggttaagctggtgtggacagaaagcgagatgatctagccatctactgcagggggcctgatcttgaacagaaacctgactgtaattgtccctggatccaggtcccagacaaagacgctggaaggaggtccctccagcccctggctcagggcccggtcagctgctggagccaggcagcttgagacatcctcctctccgaccttggcttgaggggttcatcctccagagctcaccagggccccaaggctggtacacctgagagaagagagaaacaaatcccccaacagatgtgcaatttcacctgctggcccttccattctgagatccagagccctggcaaaggagcctccaggaccaggcctgggaagcaagactggctccgccttttacgtttcagagaaagggcaggtgctataaagggcccagcgcccacgggcctgccttcaagggtacagctgtgggggccggtgcgcccggaggtctacgctgggattggtgaggtcctctggccccgccccgccagggaggatttccaggccggcccgaccagctcgccctgcatacacttcttggctgtgtgcgctcagcaggacgtgggaggctccggcttcaag

SEQ ID NO: 151 - DNA, 172 bp, Artificial
  Synthetic oligonucleotide
acactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaag

SEQ ID NO: 152 - DNA, 180 bp, Artificial
  Synthetic oligonucleotide
cgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgag

SEQ ID NO: 153 - DNA, 222 bp, Artificial
  Synthetic oligonucleotide
atcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgat

SEQ ID NO: 154 - DNA, 124 bp, Artificial
  Synthetic oligonucleotide
gcataattatgataagacatttctcatctggataaatgaggaggatcacaccagggtaatctcaatggaaaaaggaggcaatatgaaacgagtatttgagcgattctgtcgtggactaaaagaa

SEQ ID NO: 155 - DNA, 199 bp, Artificial
  Synthetic oligonucleotide
gtaagatgttatctgagatttctggatatttattaaaataaaattaccgtattgtttgttcttgaaagaagacactatggtaacttccaagatggagctaatttttttctagaaatcaaagcaactgccgcctcccaggttcaagtgattatcccgcctcagcctctagagtagctgggattacaggtgccaccaccac

SEQ ID NO: 156 - DNA, 135 bp, Artificial
  Synthetic oligonucleotide
gtagaacggttaatccaagaacgaggctgggagttcatgtggaatgagcgcctaggatacattttgacctgtccttcgaaccttggaacaggactacgagctggtgtccacgttaggatcccaaagctcagcaag

SEQ ID NO: 157 - DNA, 130 bp, Artificial
  Synthetic oligonucleotide
gtactgttatgtgcccagtggccctgatgggccaggatcagctcagatgcgactgctttgtggaggaagaaaacatcactgcccattccttaacccttactttctctatctacaatataaaaataagaaa

SEQ ID NO: 158 - DNA, 126 bp, Artificial
  Synthetic oligonucleotide
gacccacgcttttctaagatcctggaaaacctaagactccagaagcgtggcacaggtggtgtggacactgccgcggtcgcagatgtgtacgacatttccaacatagatagaattggtcgatcagag

SEQ ID NO: 159 - DNA, 376 bp, Artificial
  Synthetic oligonucleotide
gtaacgtctctctcactttcctaacatgaactaacaaaatcagcctaagagagaatagagaaaagcaaacagcctagccgttttcacaaaattcgagacctcctcttcgcccattgagtcctgagttatgttagcttttcattctgtaacattattcttccatgggaaataactgcataaagggaaacataatgtgagctgagaatttataggcaagtataggaattcacagtgggactgttgtcaccgacctgccatgagagctattccaacaatcctcagcgagcaggagctctgttatgctaaaggactgcagtttttttattactgtaaagtcagaacatctatgctatccctctgagggtggcaaaatagt

SEQ ID NO: 160 - DNA, 274 bp, Artificial
  Synthetic oligonucleotide
gttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaatataaaaaactttgcttt

SEQ ID NO: 161 - DNA, 19 bp, Artificial
  Synthetic oligonucleotide
cgcagactacccagacctg

SEQ ID NO: 162 - DNA, 96 bp, Artificial
  Synthetic oligonucleotide
gtgtttgctgacctttttgaccccgtcatcaaactaagacacaacggctatgaccccagggtgatgaagcacacaacggatctggatgcatcaaag

SEQ ID NO: 163 - DNA, 86 bp, Artificial
  Synthetic oligonucleotide
gaccactttctgtttgataagccagtgtcccctttattaacatgtgctgggatggcccgtgactggccagatgccaggggaatctg

SEQ ID NO: 164 - DNA, 665 bp, Artificial
  Synthetic oligonucleotide
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaac

SEQ ID NO: 165 - DNA, 513 bp, Artificial
  Synthetic oligonucleotide
cccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcag

SEQ ID NO: 166 - DNA, 437 bp, Artificial
  Synthetic oligonucleotide
gagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaag

SEQ ID NO: 167 - DNA, 517 bp, Artificial
  Synthetic oligonucleotide
tgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaac

SEQ ID NO: 168 - DNA, 132 bp, Artificial
  Synthetic oligonucleotide
gaagaagacgaggagaggagggaagagagggctgaggttggggccccactgagcccagaccacagcgaggaggaagaggaggaggaggaggggctggaggaagatgagccccgcttcaccatcatccccaac

SEQ ID NO: 169 - DNA, 251 bp, Artificial
  Synthetic oligonucleotide
gtgagacctcacctcacactcaaggctccactgggcctcaggatgcaccgggaccctctgaggacccccagccctaaatcctggcctctgacccaaccccttacccctgatgcaaccttgactccacaagcgatcctgactccaaccttaacctagacctagcctctggtccgggtctggtcccggccccatcctaactccgcccccggccacgccccacgctcactctctctccccgtccccgcctccag

SEQ ID NO: 170 - DNA, 327 bp, Artificial
  Synthetic oligonucleotide
gtgagcatgggcggggccctggaaaaacctgaggaaggtgccgggcccagcgtggtgaatcctggtgggggcggagcctggcccggtaggctggtggggcggggctaagaggggaggcgtggccaaggctctgagcacgtgggccggggcctggctcgaggaacaccaggtggagttgctggagccaagggacagaaatgagtggagggttgagatgcgggcttagagcctaatgggcgaggccaactcaagtaggaatcgaaggggcggggctactggagaacggaatcacccagaacgaaaaaggggtccggtagaagggattca

SEQ ID NO: 171 - DNA, 242 bp, Artificial
  Synthetic oligonucleotide
ggccctggcagacatgctggaaacgccggaaccctgacccagtcgctcgactgcgacgcaggtgtacctccccctgccttccaacccctttccacgagctatatttatttctccgaataaacgtgctccccgaaacctcattgtcagacgtggggtctgggaatctcagggcatcggggaatgcgggtagggtctagagacctggacctagacttgagggatgaggggcctggactcctggc

SEQ ID NO: 172 - DNA, 31 bp, Artificial
  Synthetic oligonucleotide
ctgagcacaggcaccacctccccagccacag

SEQ ID NO: 173 - DNA, 30 bp, Artificial
  Synthetic oligonucleotide
aagatgacaatgatgatgatgatgtctcca

SEQ ID NO: 174 - DNA, 87 bp, Artificial
  Synthetic oligonucleotide
ctgagtatggacaccaggcccacaggcaccaagaccacagaaaggaagaggttgaggctgtctcaggtgaacaccaccatcatgtcc

SEQ ID NO: 175 - DNA, 10 bp, Artificial
  Synthetic oligonucleotide
ctgaccacag

SEQ ID NO: 176 - DNA, 45 bp, Artificial
  Synthetic oligonucleotide
gcaccaaggccacagagacgaggaagaagatgaggatgtgtccac

SEQ ID NO: 177 - DNA, 18 bp, Artificial
  Synthetic oligonucleotide
caggaggaggaagaagag

SEQ ID NO: 178 - DNA, 9 bp, Artificial
  Synthetic oligonucleotide
gaagacaag

SEQ ID NO: 179 - DNA, 15 bp, Artificial
  Synthetic oligonucleotide
gaggaggaggaggag

SEQ ID NO: 180 - DNA, 64 bp, Artificial
  Synthetic oligonucleotide
ccactggacaggagagaggaggctggaggtgcctccagcgaggaggaaagcggtgaggacacag

SEQ ID NO: 181 - DNA, 71 bp, Artificial
  Synthetic oligonucleotide
gtccacaggatgctcaggagtatgggaactaccagccagggtccctgtgtggctactgctccttctgcaat

SEQ ID NO: 182 - DNA, 69 bp, Artificial
  Synthetic oligonucleotide
cgatgcactgaatgtgagagctgtcactgtgatgaggagaacatgggtgagcactgcgaccagtgccag

SEQ ID NO: 183 - DNA, 55 bp, Artificial
  Synthetic oligonucleotide
cactgtcagttctgctatctctgcccgctggtctgcgaaacggtctgcgctccag

SEQ ID NO: 184 - DNA, 8 bp, Artificial
  Synthetic oligonucleotide
gaagctac

SEQ ID NO: 185 - DNA, 29 bp, Artificial
  Synthetic oligonucleotide
gttgactatttctcctcgtccctttatca

SEQ ID NO: 186 - DNA, 276 bp, Artificial
  Synthetic oligonucleotide
acatattcagcagggttagcttgtcctcccctccctcttcagcttcccagacactgagtctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactg

SEQ ID NO: 187 - DNA, 180 bp, Artificial
  Synthetic oligonucleotide
gtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagag

SEQ ID NO: 188 - DNA, 138 bp, Artificial
  Synthetic oligonucleotide
ctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcatt

SEQ ID NO: 189 - DNA, 685 bp, Artificial
  Synthetic oligonucleotide
gtaagactcatgcaaagcactgcaaaatccagctcattaattttatgtttcttatgctttactccagtcttgctaatatagtgccaaagtccttccacctgaaacagtttccccagctgttgctgtgtatgccaggagcctaataggagagttcagtggtccaaaaaataaatagatattagatcagtgatacggattgcattgttttttgcactcatatacatctggctgatttttcagtttttctttaacttcttagattcttgggataagacttttaatgtgggccaaaaagtcacctttagagatatattattagcatcatctttgattaaaaccaagcacgtcaacactagataagaaatctggagattggagttcaggggccagttgtaccactacttggctatttggttttgagcagctaatttgcatcctctgggctgtggtttccttatctgtaaacatggggcattggagtgaaataacgcctaaagttgttccagctctaatagttcattagcccattcaaataaagccaatttatcagaaatcactaatctttttgtattctttcccccatgaagtgaaattggggaccgcttctgaagttgaactaaaaacatgtctcccattctcctaaaaatgaatggaaactttttgatagtctagcaacagtcccaga

SEQ ID NO: 190 - DNA, 671 bp, Artificial
  Synthetic oligonucleotide
gtaaatatatttctttgcttgggaatgagccaaaagaagtagactatatgaagctccggaaaacctccaatgcaaaaccgagctgattggattgaaaattgatctgagagaactaggcaaaagctcatttctccaaataaaggaaagttgggagatgagagtaggtcatgtgaaaatattttccatacatactgaaaatagaggaatatttcagggaaaagaaggaagtgaaagctgttaaactgaattcaatatcctcatcagcgagttagtcattcattttcgacacttgcctttcaacagccttgtccctccattgttcacagggcagcctgcttatggttggctgccagcaacatatacgaattctctagctgcacactttatatgatagatgccaattgctaccaatgagatttggggctagactgcatatgaaatgaattgcatctatggaaagtagctgctattcagacctcaataattcaatcactgtgatttctacgaagaccagtatgcagcataatttatgaactgaagattgagctgggaaaattctttatgtatttaaatgcagctcattttgactttatagcaaagcggcaacgggatatcaaagaaatccaagggacttggccaaaattgaatccaaaacataaacacattgaaaa

SEQ ID NO: 191 - DNA, 1074 bp, Artificial
  Synthetic oligonucleotide
gctgggaagacgccgatggatctggtgctacactggcagaatggaaccaaagcaatattcgacagcctcagagagaactcctacaagacctctcgcatagctacattctgaggcaaacgacagactcttaatcagtaaatgttcactggcattttgaaggcatggcccaagagaagagacactagccataaaatctagtttctatttatcaacgtgttgtgaagatgtacctaatgaagttttgagaaagcacagggttataggtgtttaaatttcctttagtgaaactcttatttatttttatgtattcctgtttatttatttactgccacgctactgatattcagaccttcatgatcatccatctggtgagcagagcttcatttgtatataacactttcagagccttcccacccataggtagttcttaaaccaggtgaaagagcaaagttcaagtgcctacttatgtgtcattcgctcatgtaagagtttttaagagagggctgattatcacagccctcttttctcctgaatttttaatgcagaagtttgaatgaagcaagggaaggcatgtagggacaggaaaggaaacaatggaaggaaagtgattctgtgaaaaggacagtgaagccagctattttacccccaggctggattttttttttttttttttttttttttttttaccgagtacacagagtacccaagtgaagagaacgtcatgagtgtaagtgcaaatcagtggaaggagcggcaaactgggacatgcagaattgaatttgctcaaaaaagatgaaaggaaatgcaaactgtaaatgtataaatgtatattgtattgtatgtacattttatattcataataaaggcaatcaaactctaaacctctaagtccttctataagtgtggtggaaatgtcctatgtgaaaaaaaaagctatataggagggttttttttttccattgttttccaagttttgcagattagaaatgtcccgtacaacagcactcccagtatttaatatgtatacagatcacctggggatctggttaaaatgcagatttctgattcagctgg

SEQ ID NO: 192 - DNA, 108 bp, Artificial
  Synthetic oligonucleotide
acggaacctgtggatgtgcctacgtttctgaaggctgctctggagaataaactgccagtagtagaaaaattcttgtcagacaagaacaatccagatgtttgtgatgag

SEQ ID NO: 193 - DNA, 99 bp, Artificial
  Synthetic oligonucleotide
tataaacggacagctcttcatagagcatgcttggaaggacatttggcaattgtggagaagttaatggaagctggagcccagatcgaattccgtgatatg

SEQ ID NO: 194 - DNA, 99 bp, Artificial
  Synthetic oligonucleotide
cttgaatccacagccatccactgggcaagccgtggaggaaacctggatgttttaaaattgttgctgaataaaggagcaaaaattagcgcccgagataag

SEQ ID NO: 195 - DNA, 99 bp, Artificial
  Synthetic oligonucleotide
ttgctcagcacagcgctgcatgtggcggtgaggactggccactatgagtgcgcggagcatcttatcgcctgtgaggcagacctcaacgccaaagacaga

SEQ ID NO: 196 - DNA, 99 bp, Artificial
  Synthetic oligonucleotide
gaaggagataccccgttgcatgatgcggtgagactgaaccgctataagatgatccgactcctgattatgtatggcgcggatctcaacatcaagaactgt

SEQ ID NO: 197 - DNA, 319 bp, Artificial
  Synthetic oligonucleotide
gaatctgccggtggggcgtgagcgagaagccaccaaaacatgagctaggacagccttctcaagaagattctgccaactcaaaaatattattcttttttttttttttttgctgttgtttctgagaaactaggtgtcttaccattttaaaatttcatattttatttaaaaggaaaccagtgaattgaaaatgagactaaatatcgctatcttctttggagctctctttggtgctttgggggtgttactctttttggtggcttttggatcggattattggcttcttgcaactgaagtggggagatgttcaggtgaaaagaat

SEQ ID NO: 198 - DNA, 405 bp, Artificial
  Synthetic oligonucleotide
gtcttctttgattcctcatggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacacttcatgctaaaaactctcaataaattaggtattgacgggatgtatctcaaaataataagagctatctatgacaaacccacagccaatatcatactgaatgggcaaaaactggaagcattccctttgaaaactggcaaaagacagggatgccctctctcaccactcctattcaacatagtgttggaagttctgg

SEQ ID NO: 199 - DNA, 138 bp, Artificial
  Synthetic oligonucleotide
tttaccgtggtttctgggcagtcctgatgctcctgggggtagttgctgtagtcatcgcaagctttttgatcatctgtgcagcccccttcgccagccattttctctacaaagctgggggaggctcatatattgctgcag

SEQ ID NO: 200 - DNA, 188 bp, Artificial
  Synthetic oligonucleotide
gcatcctattttcattggtggtgatgctgtatgtcatctgggtccaggcagtggctgacatggaaagctaccgaaacatgaaaatgaaggactgcctggatttcaccccttctgttctgtatggctggtcatttttcctggccccagctgggatatttttttctttgctagctggattactatttctg

SEQ ID NO: 201 - DNA, 3478 bp, Artificial
  Synthetic oligonucleotide
gttgttggacggcatattcagatacatcactaaatcaactgttgccacaagtattttcttgagagattttaaaacaaggaatactttttttccattttgtttcattgatcccagcataaagttagtagatataactttttagttgctattcaaattaatcattttactaaaattttcttcagtaagaaggtcctagaatctctccagacaccagcaagcctctatcttgtctaagtgctgtcaaggacctagttctttagggaataggtaaacaggtctccctttcattgaacatgttagagttcatgcaggtcgcaaaggcctgataatagcttaataccatgacatggggaaaatctcgatagatttggcttaaagtctccttggcattcacttctgctaattaaaaaaaatccttgaagaataattaagaatgggcaaggttgtcagagaatttattttgtttcttgcccacacagataatatccacatacacattcactggctcttgtgagcaaatgaatttaaaaatagacagcagttgttctaattagtgggagccatgtactcaccagttaaaatgggccacaacaaacaagactgagagcatgtacttatcttgctttttcaccaacagtggtttggttacctagttttattcacttaattgtgcatgcttacataaactttaaactacatttaaaactagcaaatctgcataccaaattatgtataacgtagattgaatttttatgaacttaaagtgagttaattgtataatgtaatattgtttaaaatatgtaaaaaccaagcatttccgcttggtccataattctatttgatattttaaaattctcatttaaaaattatattgctatcattcagcatgtgaaaatttattgataaaatgtgattttaatattttttagatataaactttcaacgtacttccatatgaggattataatagccctgctttattaaagaccataaaatattaactttccccaagatgttatgggttccagttcttctgatcatttgattcctttaattactgtccctcaatttcttcatctttacaatagatatattaacatttacagatcgactatttcctttaacctcctagaagaaagtttttgtggggaaagatgattctgtattattcagtagcatagacattttgcatatcaaagatgttcatttggcactaatgttgattgaaatcaaatccatctgagatgcctagctcgtatttgcattctggaagcctccatcgcaggggagctcggcagggtatgtgagctttgttggaggtgcggtgtttcattctgcagctgttgtgaggacagagaggcatggcccacaggcaaaaaaagtcaccacccagaagatgctctgggatagaggaactgctccttttcatcagctcttccaatgccgtgggagaggtgatcccagtcttctctgtacatcttgtgcttttccattaagacttgttccagtgggaaggagctttggaaaaattgcaaaggtctgaatcttcagggcattttcatgacaggacttgccaataataataataataataataataataataataataataaagctccagaggcctaactggtttctcaagtcatttcagtgatatcattgaaacgtttttgtggtacttccctttgtctttcactgtttcatttttatattgcttcatttacttctttgcttttggctttgttattagaaaaaataattatgaggtctgttgtgcatgttgactgtgatattaagttatggcatgccattaagttttccagacgatgttggatgtatctgattagttcatgtcatctgtaaatacaattcttttttgtagtactttggaatggagcctttttctggtgtactgtatgccatttaagtttcacatacaagctgctttcggcaaaggcttgaatatttataaatttcagatggttatcctcactttatagtacacttaagtggctaccatatattttttatatgacaattggctgaatagctgatgtgtatgacacttttacacagatttgcactttggaactattttatagttgtaatgcatcaatcaaatacatttcaagcacatttcttgatcaatttaccagcaaccctctgaaggaatgaaggagagttgtgattgctatgtcaatgagtgaaatatacttaaaaatggcagagttatatagtacattattgtagcaaccttatatctgatttgagatactgtgttgccaaatgtccatgttatgtttatttctctattggttgtatttattaatttttagaagcctttaaactgtgttagaatctttttgaaaaatgttgattttgcatcataaagtttcaatttatcaaggatatcttttcagttacacttttagaaagagtgaataaaaagggcagtgagttatgctcttggacttggtgaaagctatcatctctccatattgtatttgttcagctggtttaattcactcaggtggatgattgcacatacattggaattggctggagagactacacagagaagtttaatgatcgtgtacaatttgagggttgatggtagggctttctaaaaaaagtaatatcaagtgtgttgttagtattcatttagtcatttttattactaatctataaatatatttattaaatttgaagattaaatggaattataaaggaatatattggaggaagtgtcagtgttggtaattattcatctatttatctgtctatcatcaatatatatgggtgcatgtctgtgtatatttgtgtgtatgtaagtgtgcatgtgtattatatgtttgggtagaaagagatacattgaatggtataaatcaatatatttgagctaagcaagttaaaaaaaaatcagttatctttgggaacagcaatctattattgttgtttccctgagtgccactttaactgtttcactcaatggatggtggtttattcagttcaacacgtaatttgatttctattttcttaaaagtaaccatgttggacttacaaagagacttagaatgtcagaggtgttaggcagatattggataccagtaaaattggctggatatgtctgaaggtcggtggaattgtgagaaagaccaatggtgatggggttacattgaagaaaatataagatgagctaaatcaaaaccagatttgatttttttgggactccaccagaagtggaaactcataaacaagagatgaaacagaaaactacatttttattgattgtatgaaggagttaaatatatggagacatttcctcagtgatgatcaagggtaggtggggaaattccaataagaatgtaggatgacaataccttagatatgttgaaaaccaaggaggatggggatatagtatctttcgtattataataagcataaagttagcaaagggacatttaatttggttagc

SEQ ID NO: 202 - DNA, 427 bp, Artificial
  Synthetic oligonucleotide
atggaatttcttctctctgttactcaagcctctcaaagtccttattgtcccagcctctgcgtgaaacgtcttcagccatcaatgacatctcactccttcaagcccttatgccactgctgggatggaccagtcactggacctgcattacagtgggcttatattgacctttacctctacacttgtatataactcgttttcccatttagttgcaagacacttggaagcacagaccaaggcttacatttgtgttttaatgtttttcttgtaaatgctttatgcctaaatgtttctgtactactcttctttccaaatccttattgtttaaaagtttctctcctactataccatgccttataaatattgattgaatgaatggatgaaatgcatacctgcttatatttctaattaaaggcaatttgggattata

SEQ ID NO: 203 - DNA, 342 bp, Artificial
  Synthetic oligonucleotide
tttctgtgggtcaagagtgtggaagtggctaagcagaatgagtccagctcagaatcccatgagtctgctaatcaagctattttctggggttgcaatcatctgaaggcccagctggggctaaagaacgcactttgcagctcgctttttgcctggctcagaagatccatttccagactcacttacactggcaggcctcagttccttgccatgtgaatcactgggatgggctgcctggacctcctcaggatacagcaattgctaataaaagaggtttaaggggaaccagagaactagacgataaaagaagttggctaacatgaaagccccacctccaacattggg

SEQ ID NO: 204 - DNA, 104 bp, Artificial
  Synthetic oligonucleotide
agagagggggcgggtgctacctggcagctccgcgggtgcgtggccggtgctggctgggagttctggtctcaggcaaggtggggactgggcacatcatcaatacg

SEQ ID NO: 205 - DNA, 95 bp, Artificial
  Synthetic oligonucleotide
atagagaacgtcacttttcaccatgaagggttcttctggaggtgttggtttaatgggattgtggaagagaatgactccaatatttggaagttctg

SEQ ID NO: 206 - DNA, 5 bp, Artificial
  Synthetic oligonucleotide
gtaca

SEQ ID NO: 207 - DNA, 99 bp, Artificial
  Synthetic oligonucleotide
ccaatcagccaccgtccaagaactgcacacatgcttacctgtctccgtaccccttcatgagaggcgagcacaactcgacctcctatgactctgcagtta

SEQ ID NO: 208 - DNA, 110 bp, Artificial
  Synthetic oligonucleotide
gaatctagaagatggggggatggaagtgaagtggaatgtaaaaacgtctgccagtgccccatggtctccaacccactttcagatgcaccgtctcatttcaacagatatag

SEQ ID NO: 209 - DNA, 328 bp, Artificial
  Synthetic oligonucleotide
gcacgcatcgaggagctggaggaggagctggaggccgagcgcaccgccaggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagag

SEQ ID NO: 210 - DNA, 214 bp, Artificial
  Synthetic oligonucleotide
gggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaag

SEQ ID NO: 211 - DNA, 122 bp, Artificial
  Synthetic oligonucleotide
acggtgactgtgaaggaggaccaggtgttgcagcagaacccacccaagttcgacaagattgaggacatggccatgctgaccttcctgcacgagcccgcggtgcttttcaacctcaaggagcg

SEQ ID NO: 212 - DNA, 157 bp, Artificial
  Synthetic oligonucleotide
acctactcgggcctcttctgtgtcactgtcaacccctacaagtggctgccggtgtacaatgccgaagtggtggccgcctacaggggcaagaagaggagtgaggccccgccccacatcttctccatctccgacaacgcctatcagtacatgctgacag

SEQ ID NO: 213 - DNA, 269 bp, Artificial
  Synthetic oligonucleotide
atgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgac

SEQ ID NO: 214 - DNA, 171 bp, Artificial
  Synthetic oligonucleotide
ttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaag

SEQ ID NO: 215 - DNA, 819 bp, Artificial
  Synthetic oligonucleotide
gtgcctccttggcctcaccacctatgccccctcctctgccatccagacaaagtggtggctgagtcccttctacacccaagaaactagagtcccaagaatcccaggcctttctccaggcccagcttctccccactgtgaagtcatgggcatgaacaggatgatccccccactcttcctttcccaggaccttgcactttatgcccctttgtggtggtcccctcagtgtcttaagagtgagatgtagtgaaggagaggcccctggcccctctgaccgcccatgagaagcgtcattcatggaaagatcctaggctgaaattagagatgtttggcctcccaccaccttcctgttggttgagaaataagccagtctccagccctcttgcttatgggcattcctcagaagagacaaggccgcaggcgggaggccccataggccggggctgacttgctctcagtgaacctctgctctttgtcagcataggccagagcccggattgtctgacccacacccagcccagccacggccttcatgaaatgggagcttccccacatgctttgggtcattatccagattcttaaccagagttctcatgtttcagagccctcagaatgccataaaactgtgtgtggaaaaaagcatgtgtacattcatacatacatgtgtgtgcttgtgcatgtgtgtgtgtgtacgtgtgtgtgtgtacatgcgtttttctggagagacagtctttagcttcaacaaattcttaaaaggattcctgccccaagaaaaatcaagaaccaccaggtttttggaagtgcagagtgtggtaaagaacc

SEQ ID NO: 216 - DNA, 132 bp, Artificial
  Synthetic oligonucleotide
gtaccagcacagcgccccttcagcaggccagcgctactggctccagattccttttcctgtcagggtatgggactgtggaagcctgggagtgtgctcagtgattctctctttgcctcttcaccctgccctcag

SEQ ID NO: 217 - DNA, 310 bp, Artificial
  Synthetic oligonucleotide
cccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactg

SEQ ID NO: 218 - DNA, 124 bp, Artificial
  Synthetic oligonucleotide
gtatcgcatcctgaacccagtggccatccctgagggacagttcattgatagcaggaaggggacagagaagctgctcagctctctggacattgatcacaaccagtacaagtttggccacaccaag

SEQ ID NO: 219 - DNA, 137 bp, Artificial
  Synthetic oligonucleotide
gtgttcttcaaggcagggctgcttgggctgctggaggagatgcgggatgagaggctgagccgcatcatcacgcgcatgcaggcccaagcccggggccagctcatgcgcattgagttcaagaagatagtggaacgcag

SEQ ID NO: 220 - DNA, 256 bp, Artificial
  Synthetic oligonucleotide
ggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcg

SEQ ID NO: 221 - DNA, 243 bp, Artificial
  Synthetic oligonucleotide
gaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaag

SEQ ID NO: 222 - DNA, 177 bp, Artificial
  Synthetic oligonucleotide
gtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgat

SEQ ID NO: 223 - DNA, 146 bp, Artificial
  Synthetic oligonucleotide
ctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaa

SEQ ID NO: 224 - DNA, 270 bp, Artificial
  Synthetic oligonucleotide
gcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgag

SEQ ID NO: 225 - DNA, 337 bp, Artificial
  Synthetic oligonucleotide
gtgaggcccagtggggagggtgggcaggcttgatggcagccctggggcaattcatctcagtgccagaaatggagcctggagctggaaagagtcctctgcaagggaaagaccctccagtctaggttctgccctgcagctaagcgtcatttaatgcctcttttcttattcgtaaggggatggggtgagcagactgggaaactcctcaaacagtgaggtgccacatcagcccacatggtgaataaggctgggcttggttgaagtactacataagaagagaatctagagaatggggcacagggagtccctcccacctcctggtgcccccccccctccccag

SEQ ID NO: 226 - DNA, 184 bp, Artificial
  Synthetic oligonucleotide
aaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaag

SEQ ID NO: 227 - DNA, 166 bp, Artificial
  Synthetic oligonucleotide
atcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcagg

SEQ ID NO: 228 - DNA, 135 bp, Artificial
  Synthetic oligonucleotide
gaggagggcaagatcctccgggcccagctagagttcaaccagatcaaggcagagatcgagcggaagctggcagagaaggacgaggagatggaacaggccaagcgcaaccaccagcgggtggtggactcgctgcag

SEQ ID NO: 229 - DNA, 129 bp, Artificial
  Synthetic oligonucleotide
acctccctggatgcagagacacgcagccgcaacgaggtcctgagggtgaagaagaagatggaaggagacctcaatgagatggagatccagctcagccacgccaaccgcatggccgccgaggcccagaag

SEQ ID NO: 230 - DNA, 204 bp, Artificial
  Synthetic oligonucleotide
gacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccag

SEQ ID NO: 231 - DNA, 198 bp, Artificial
  Synthetic oligonucleotide
gtaagtgaccgcccaccttccgcctcccctaaagacagaaacaaggccttgggtccaggccaggccactgtgctgtaacaccaagccaactctgcagttctgtggatttgagggcctgatgggagaaaggagatccttggggggcaaaaggccccggcccctggcccatgttccttgccacctctctcctgcacacag

SEQ ID NO: 232 - DNA, 276 bp, Artificial
  Synthetic oligonucleotide
gccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccag

SEQ ID NO: 233 - DNA, 224 bp, Artificial
  Synthetic oligonucleotide
gtgcggcggacgccagacaccgggagtagatgtggaagtttcttctctggccccactgccccgccctcacagggctcctctcacctcctccttgagatgctgttggtagatttaacgttcttctcacgctctgcagtcagtttgacttgagtctatgagtttttccagcaaatgaagaatctacttctacttcctgaaaactcttctaactagtctttccccag

SEQ ID NO: 234 - DNA, 897 bp, Artificial
  Synthetic oligonucleotide
gtttctttctttctttttttttttttttaataactctaagtgctaccatgaagacttcagaacagttcaaagaatccttccaccttcgactgtggggataagagtcaggggaggggaaaagacccggaaatcttccatagaacttctggcacacaaagagaaggccacagagaaagaggaccctagaatgctctaaaacctccacttgcatagctgagagctgtgcccttggcccgttattttcagtgtacctgggaagaaaaggccaaggagacgagggtgtcagtccatttgatagatggataccagaggcacaagaaagaggttacagatacagaaccacagagtgatttgtggacagaagtagaaatggcatcctggcacatacaatgataaagagataggaatgatcgagtgacgttggagccagtgatcccgatgcctgaattctggcccagtacaatatattagaatgtagaataatctggattatgataatacccccttctttctgcattctttttctggtcaagaactactggccaagagaacctatgtaagtccaggttggagctttatccaccatactggagctggaacagacctggtgcttttatattaccacattagggaattccattaggttctgagcccctccccctacttctagctttatgacttcagccttcattgctctgtggatccctgactgacaaccttgcattgcccctttgacctacgatagagtcagagaatcttccccaccacctctttgacctggatcattgcagggaggggcagcaaaggcaaggggagaagagtaaaatgatggaggagggaaaggtgattgcatttgctccccctccaaaccagcttctcccaccctcccacccccag

SEQ ID NO: 235 - DNA, 135 bp, Artificial
  Synthetic oligonucleotide
gaggagcaagccaacaccaacctgtccaagttccgcaaggtgcagcatgagctggatgaggcagaggagcgggcggacatcgctgagtcccaggtcaacaagcttcgagccaagagccgtgacattggtgccaag

SEQ ID NO: 236 - DNA, 1927 bp, Artificial
  Synthetic oligonucleotide
caaaaaatgcacgatgaggagtgacactgcctcgggaacctcactcttgccaacctgtaataaatatgagtgccaaactctgcctgagcccatctgtccttcctgccagctgtccatcctggatcagggcagtagggggcctgagaggagggaggcccccagcccctgtatcagagctgccagagccaaggcatcccatatccacaaggaaggagaccgaggtgcagaggagtgaggtgttctgcctgacgtggacagctgtgagtcccagttctgctcagtcaaccacacaagggtggagagggagaaatttcaaaagtgaagaaaacaatggcatcaaaatggtgagccagtccaagatgctacgagatagaattttggtgccgaagttgaagccactctccacctaccccacccctgaggctgcaatgattaaaggtgtcctaggacacccattctttctgaaatgaattttccaccaatgccagaaaaggctcagagctggctgagaattaaggtatgggaaaggagatgggagagattccattctagtcagcccctaggaagtaactcccagggagccccctccctgtcttccccaggggtctccccctgcctcctatgattcagcacctcaccgtgagggcatcttgagactctggggccaatcaacactgagcccaaaccaatatgccatgaggaccaagcctgggcattgctcatttcatgttggttctcacacagacacagatggcacaggtgcctgtacagggaaacactgtggtcacatttctgctctctctaagctcctactggggacagtctggcctggatcacacagctgcttgtgggacaggcccggtcctgaccccgttctgcacaaagcaaatccccactccccactgggctttgcagccaggctctgctgaccgcctccttaaccgttcacctggcaccccatctccctgactccccaagtggagcctcttctatccctcctctgagaccatgagaatggactgtgcataaagccctgagaaatgtgagcagtgaccagagaaacacaaaatcctgttggttctagcccaggagaggctgccagttctgatggtgagccaggacacaaggataggagaacaggaagcaggaggcaggaaaaagaccaagagagaggagtggctgccaccaaggaagcagagcgctctgaccagagttcaagatccagggttcgggcaggacttgggagctggggcctgcagctggaaggagcgctccagaagaaggattgtatctcagggcgggaacacacacacatcagcgacaggagatagcacgtcagctgggatggagctgctgagccaggccatgctgggctcctcgggctgggcaggaacgtctggctgcacatctgtctgtctcggcccagcagggctgactcccgggctgtggcagtgtctgctccaaactcccctgggccttcccatagcattcactgtggggagctcttgaccagcttgtctctttcccagcctgtgagtgctaaagggcaggccccccgtcacctctgaggccctggcacccagcacagtgtgcatgggagatgctcaggaaatgtgtgctgaggagctggcaagctgggagggtggacccgcagtggagggaagagttggccattcttttctgagctacaaggaggctcagtacagtatccagaacactcgcttaggtgtcagaagagctgcgttctggccctagctctgtcacaaatgagttcacctcccctggctgggcctgttttctcttatgtgaaatgagggcattggaccagctgataatcaacggctctcccagcattcgcattttgggaaatctctccctcctctgatacctcaggctgccctctccctgcctcctgttcctgtcatag

SEQ ID NO: 237 - DNA, 21 bp, Artificial
  Synthetic oligonucleotide
cctatcagtacatgctgacag

SEQ ID NO: 238 - DNA, 46 bp, Artificial
  Synthetic oligonucleotide
cgagttcaagctggagctggatgacgtcacctccaacatggagcag

SEQ ID NO: 239 - DNA, 15 bp, Artificial
  Synthetic oligonucleotide
atcatcaaggccaag

SEQ ID NO: 240 - DNA, 31 bp, Artificial
  Synthetic oligonucleotide
gaggacagatagagagactcctgcggcccag

SEQ ID NO: 241 - DNA, 33 bp, Artificial
  Synthetic oligonucleotide
attcttcaggattctccgtgaagggataaccag

SEQ ID NO: 242 - DNA, 22 bp, Artificial
  Synthetic oligonucleotide
ctacgcggcctggatgatatat

SEQ ID NO: 243 - DNA, 28 bp, Artificial
  Synthetic oligonucleotide
atcgggagaaccagtccatcctcatcac

SEQ ID NO: 244 - DNA, 112 bp, Artificial
  Synthetic oligonucleotide
gggagaatccggggcggggaagactgtgaacaccaagcgtgtcatccagtactttgccagcattgcagccataggtgaccgtggcaagaaggacaatgccaatgcgaacaag

SEQ ID NO: 245 - DNA, 93 bp, Artificial
  Synthetic oligonucleotide
ggcaccctggaggaccagatcatccaggccaaccccgctctggaggccttcggcaatgccaagactgtccggaacgacaactcctcccgcttt

SEQ ID NO: 246 - DNA, 64 bp, Artificial
  Synthetic oligonucleotide
gggaaattcattaggatccactttggggccactggaaagctggcttctgcagacatagagacct

SEQ ID NO: 247 - DNA, 99 bp, Artificial
  Synthetic oligonucleotide
acctgctggagaagtcccgggtgatcttccagctgaaagctgagagaaactaccacatcttctaccagattctgtccaacaagaagccggagttgctgg

SEQ ID NO: 248 - DNA, 104 bp, Artificial
  Synthetic oligonucleotide
acatgctgctggtcaccaacaatccctacgactacgccttcgtgtctcagggagaggtgtccgtggcctccattgatgactccgaggagctcatggccaccgat

SEQ ID NO: 249 - DNA, 117 bp, Artificial
  Synthetic oligonucleotide
agtgcctttgacgtgctgggcttcacttcagaggagaaagctggcgtctacaagctgacgggagccatcatgcactacgggaacatgaagttcaagcagaagcagcgggaggagcag

SEQ ID NO: 250 - DNA, 22 bp, Artificial
  Synthetic oligonucleotide
gcggagccagacggcaccgaag

SEQ ID NO: 251 - DNA, 71 bp, Artificial
  Synthetic oligonucleotide
gggacagtggtaaaagcaaaggaggcaagaaaaagggctcatccttccagacggtgtcggctctccaccgg

SEQ ID NO: 252 - DNA, 88 bp, Artificial
  Synthetic oligonucleotide
gaaaatctcaacaagctaatgaccaacctgaggaccacccatcctcactttgtgcgttgcatcatccccaatgagcggaaggctccag

SEQ ID NO: 253 - DNA, 118 bp, Artificial
  Synthetic oligonucleotide
gggtgatggacaaccccctggtcatgcaccagctgcgctgcaatggcgtgctggagggcatccgcatctgcaggaagggcttccccaaccgcatcctctacggggacttccggcagag

SEQ ID NO: 254 - DNA, 91 bp, Artificial
  Synthetic oligonucleotide
gaaggagtttgacattaatcagcagaacagtaagattgaggatgagcaggcgctggcccttcaactacagaagaaactgaaggaaaaccag

SEQ ID NO: 255 - DNA, 12 bp, Artificial
  Synthetic oligonucleotide
ctgggcgagcag

SEQ ID NO: 256 - DNA, 30 bp, Artificial
  Synthetic oligonucleotide
atcgacaacctgcagcgggtgaagcagaag

SEQ ID NO: 257 - DNA, 78 bp, Artificial
  Synthetic oligonucleotide
ctggagaaggagaagagcgagttcaagctggagctggatgacgtcacctccaacatggagcagatcatcaaggccaag

SEQ ID NO: 258 - DNA, 102 bp, Artificial
  Synthetic oligonucleotide
gcaaacctggagaaagtgtctcggacgctggaggaccaggccaatgagtaccgcgtgaagctagaagaggcccaacgctccctcaatgatttcaccacccag

SEQ ID NO: 259 - DNA, 25 bp, Artificial
  Synthetic oligonucleotide
cgagccaagctgcagaccgagaatg

SEQ ID NO: 260 - DNA, 119 bp, Artificial
  Synthetic oligonucleotide
gagagttggcccggcagctagaggaaaaggaggcgctaatctcgcagctgacccgggggaagctctcttatacccagcaaatggaggacctcaaaaggcagctggaggaggagggcaag

SEQ ID NO: 261 - DNA, 24 bp, Artificial
  Synthetic oligonucleotide
gcgaagaacgccctggcccatgca

SEQ ID NO: 262 - DNA, 66 bp, Artificial
  Synthetic oligonucleotide
ctgcagtcggcccggcatgactgcgacctgctgcgggagcagtacgaggaggagacagaggccaag

SEQ ID NO: 263 - DNA, 72 bp, Artificial
  Synthetic oligonucleotide
gccgagctgcagcgcgtcctgtccaaggccaactcggaggtggcccagtggaggaccaagtatgagacggac

SEQ ID NO: 264 - DNA, 35 bp, Artificial
  Synthetic oligonucleotide
gccattcagcggactgaggagctcgaagaggccaa

SEQ ID NO: 265 - DNA, 104 bp, Artificial
  Synthetic oligonucleotide
gtgtgctgggggtccaagaggccagagatgagttggtgggagggagggccatgcaggggcagggggaacataggctttgagctttctggccctctggtccccag

SEQ ID NO: 266 - DNA, 77 bp, Artificial
  Synthetic oligonucleotide
aggaaatctcggaccttactgagcagctaggagaaggaggaaagaatgtgcatgagctggagaaggtccgcaaacag

SEQ ID NO: 267 - DNA, 21 bp, Artificial
  Synthetic oligonucleotide
ctggaggtggagaagctggag

SEQ ID NO: 268 - DNA, 27 bp, Artificial
  Synthetic oligonucleotide
ctgcagtcagccctggaggaggcagag

SEQ ID NO: 269 - DNA, 15 bp, Artificial
  Synthetic oligonucleotide
gcctccctggagcac

SEQ ID NO: 270 - DNA, 30 bp, Artificial
  Synthetic oligonucleotide
caagtcaagagcctccagagcttgctgaag

SEQ ID NO: 271 - DNA, 57 bp, Artificial
  Synthetic oligonucleotide
aacaccagcctcatcaaccagaagaagaagatggagtcggatctgacccagctccag

SEQ ID NO: 272 - DNA, 69 bp, Artificial
  Synthetic oligonucleotide
tcggaagtggaggaggcagtgcaggagtgcagaaacgccgaggagaaggccaagaaggccatcacggat

SEQ ID NO: 273 - DNA, 96 bp, Artificial
  Synthetic oligonucleotide
acagaggaagacaaaaagaacctgctgcggctacaggacctggtggacaagctgcaactgaaggtcaaggcctacaagcgccaggccgaggaggcg

SEQ ID NO: 274 - DNA, 20 bp, Artificial
  Synthetic oligonucleotide
gccaactctcagctcctccc

SEQ ID NO: 275 - DNA, 101 bp, Artificial
  Synthetic oligonucleotide
ttccttggcatctccaatggagtagagagaaggcaacaaagcttctcagacccacattaccgagctataacaaccatggctgggaggagctgagagttggc

SEQ ID NO: 276 - DNA, 21 bp, Artificial
  Synthetic oligonucleotide
ccaagcctaccacaatcatcg

SEQ ID NO: 277 - DNA, 21 bp, Artificial
  Synthetic oligonucleotide
ctccacccccaacttaaagct

SEQ ID NO: 278 - DNA, 101 bp, Artificial
  Synthetic oligonucleotide
ccaagcctaccacaatcatcgaaaagaatggggacattctcaccctaaaaacacacagcaccttcaagaacacagagatcagctttaagttgggggtggag

SEQ ID NO: 279 - DNA, 22 bp, Homo sapiens
atatcccagtggtggttgcatt

SEQ ID NO: 280 - DNA, 17 bp, Homo sapiens
ccctccccagcgtttcc

SEQ ID NO: 281 - protein, 215 aa, Homo sapiens
MVDAFLGTWKLVDSKNFDDYMKSLGVGFATRQVASMTKPTTIIEKNGDILTLKTHSTFKNTEISFKLGVEFDETTADDRKVKSIVTLDGGKLVHLQKWDGQETTLVRELIDGKLILVRWATLELYLIGYYYCSFSQACSKKPSPPLRAVEAGTREWLWVRVVSGGNFLCSGFGLTQAGTQILPYRLHDCGQITFSKCNCKTGINNTNLVGLLGSL

SEQ ID NO: 282 - protein, 178 aa, Homo sapiens
MVDAFLGTWKLVDSKNFDDYMKSLGVGFATRQVASMTKPTTIIEKNGDILTLKTHSTFKNTEISFKLGVEFDETTADDRKVKSIVTLDGGKLVHLQKWDGQETTLVRELIDGKLILDVLTAWPSIYRRQVKVLREDEITILPWHLQWSREKATKLLRPTLPSYNNHGWEELRVGKSIV

SEQ ID NO: 283 - protein, 126 aa, Homo sapiens
MVDAFLGTWKLVDSKNFDDYMKSLGVGFATRQVASMTKPTTIIEKNGDILTLKTHSTFKNTEISFKLGVEFDETTADDRKVKSIVTLDGGKLVHLQKWDGQETTLVRELIDGKLILMEKLQLRNVK

SEQ ID NO: 284 - protein, 144 aa, Homo sapiens
MVDAFLGTWKLVDSKNFDDYMKSLAHILITFPLPSGVGFATRQVASMTKPTTIIEKNGDILTLKTHSTFKNTEISFKLGVEFDETTADDRKVKSIVTLDGGKLVHLQKWDGQETTLVRELIDGKLILTLTHGTAVCTRTYEKEA

SEQ ID NO: 285 - protein, 240 aa, Homo sapiens
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVLWLTPVIPTLWEADGGGLHEPWSWRPAWATWLQRNYL

SEQ ID NO: 286 - protein, 446 aa, Homo sapiens
MKRTHLFIVGIYFLSSCRAEEGLNFPTYDGKDRVVSLSEKNFKQVLKKYDLLCLYYHEPVSSDKVTQKQFQLKEIVLEHWQISQWWLHFQTPREEGKMKLLELSESADGAAWKRWGGNSNTHRIQLVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 287 - protein, 337 aa, Homo sapiens
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 288 - protein, 321 aa, Homo sapiens
NETEAEQSYVRAEEGLNFPTYDGKDRVVSLSEKNFKQVLKKYDLLCLYYHEPVSSDKVTQKQFQLKEIVLELVAQVLEHKAIGFVMVDAKKEAKLAKKLDYKAFEEAAEHFQPYIKFFATFDKGVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 289 - protein, 212 aa, Homo sapiens
MSSWLSAGSPSSLSVVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 290 - protein, 133 aa, Homo sapiens
MCRGYSTLLNPVSDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 291 - protein, 252 aa, Homo sapiens
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVAKKLSLKMNEVDFYEPFMDEPIAIPNKPYTEEELVEFVKEHQRSRNWTQ

SEQ ID NO: 292 - protein, 451 aa, Homo sapiens
MEISLVKCSEANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPSQTGRTREIVMPSRNYTPYTRVLELTMKKTLT

SEQ ID NO: 293 - protein, 438 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEENNELQSRLDYLTETQAKTEVETREIGVGCDLLPSQTGRTREIVMPSRNYTPYTRVLELTMKKTLT

SEQ ID NO: 294 - protein, 407 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGEPNRQDS

SEQ ID NO: 295 - protein, 390 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIMSHELFSRFSLRLFGR

SEQ ID NO: 296 - protein, 466 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPSQTGRTREIVMPSRNYTPYTRVLELTMKKTLT

SEQ ID NO: 297 - protein, 145 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKPLVDLYSRRYFLTVPYEECKWRRSLPGRHEVPRGALP

SEQ ID NO: 298 - protein, 121 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYNLPGRHEVPRGALP

SEQ ID NO: 299 - protein, 101 aa, Homo sapiens
MPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 300 - protein, 118 aa, Homo sapiens
MSSFSTTTNLLDHLEEKMPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 301 - protein, 137 aa, Homo sapiens
MADGSSDAAREPRPAPAPIRRRSSNYRAYATEPHAKKKSKISASRKLQLKTLLLQIAKQELEREAEERRGEKGRALSTRCQPLELAGLGFAELQDLCRQLHARVDKVDEERYDIEAKVTKNITEVGRMGSSGTFGVG

SEQ ID NO: 302 - protein, 182 aa, Homo sapiens
MADGSSDAKKSKISASRKLQLKTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESLDLRAHLKQVKKEDTEKENREVGDWRKNIDALSGMEGRKKKFES

SEQ ID NO: 303 - protein, 86 aa, Homo sapiens
MADGSSDAAREPRPAPAPIRRRSSNYRAYATEPHAKVGRGFLGAEYRRRRDPRPWEWGEEPGLRRGRGLRGGASGAEFCRGSCSDW

SEQ ID NO: 304 - protein, 13 aa, Homo sapiens
MADGSSDAVRAAG

SEQ ID NO: 305 - protein, 387 aa, Homo sapiens
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKDPRFSKILENLRLQKRGTGGVDTAAVADVYDISNIDRIGRSEVTSLSLS

SEQ ID NO: 306 - protein, 346 aa, Homo sapiens
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKVLLCAQWP

SEQ ID NO: 307 - protein, 224 aa, Homo sapiens
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDA

SEQ ID NO: 308 - protein, 304 aa, Homo sapiens
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVRCYLRFLDIY

SEQ ID NO: 309 - protein, 708 aa, Homo sapiens
MGHHRPWLHASVLWAGVASLLLPPAMTQQLRGDGLGFRNRNNNTGVAGLSEEASAELRHHLHSPRDHPDENKDVSTENGHHFWSHPDREKEDEDVAKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQVRPHLTLKAPLGLRMHRDPLRTPSPKSWPLTQPLTPDATLTPQAILTPTLT

SEQ ID NO: 310 - protein, 685 aa, Homo sapiens
MGHHRPWLHASVLWAGVASLLLPPAMTQQLRGDGLGFRNRNNNTGVAGLSEEASAELRHHLHSPRDHPDENKDVSTENGHHFWSHPDREKEDEDVAKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGEHGRGPGKT

SEQ ID NO: 311 - protein, 696 aa, Homo sapiens
MGHHRPWLHASVLWAGVASLLLPPAMTQQLRGDGLGFRNRNNNTGVAGLSEEASAELRHHLHSPRDHPDENKDVSTENGHHFWSHPDREKEDEDVAKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQGPGRHAGNAGTLTQSLDCDAGVPPPAFQPLSTSYIYFSE

SEQ ID NO: 312 - protein, 613 aa, Homo sapiens
MGHHRPWLHASVLWAGVASLLLPPAMTQQLRGDGLGFRNRNNNTGVAGLSEEASAELRHHLHSPRDHPDENKDVSTENGHHFWSHPDREKEDEDVAKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTAMH

SEQ ID NO: 313 - protein, 283 aa, Homo sapiens
MMVLKVEELVTGKKNGNGEAGEFLPEDFRDGEYEAAVTLEKQEDLKTLLAHPVTLGEQQWKSEKQREAELKKKKLEQRSKLENLEDLEIIIQLKKRKKYRKTKVPVVKEPEPEIIYKRTALHRACLEGHLAIVEKLMEAGAQIEFRDMLESTAIHWASRGGNLDVLKLLLNKGAKISARDKLLSTALHVAVRTGHYECAEHLIACEADLNAKDREGDTPLHDAVRLNRYKMIRLLIMYGADLNIKNCAGKTPMDLVLHWQNGTKAIFDSLRENSYKTSRIATF

SEQ ID NO: 314 - protein, 197 aa, Homo sapiens
MMVLKVEELVTGKKNGNGEAGEFLPEDFRDGEYEAAVTLEKQEDLKTLLAHPVTLGEQQWKSEKQREAELKKKKLEQRSKLENLEDLEIIIQLKKRKKYRKTKVPVVKEPEPEIITEPVDVPTFLKAALENKLPVVEKFLSDKNNPDVCDEYKRTALHRACLEGHLAIVEKLMEAGAQIEFRDMVNIFLCLGMSQKK

SEQ ID NO: 315 - protein, 177 aa, Homo sapiens
MMVLKVEELVTGKKNGNGEAGEFLPEDFRDGEYEAAVTLEKQEDLKTLLAHPVTLGEQQWKSEKQREAELKKKKLEQRSKLENLEDLEIIIQLKKRKKYRKTKVPVVKEPEPEIITEPVDVPTFLKAALENKLPVVEKFLSDKNNPDVCDEVRLMQSTAKSSSLILCFLCFTPVLLI

SEQ ID NO: 316 - protein, 286 aa, Homo sapiens
MMVLKVEELVTGKKNGNGEAGEFLPEDFRDGEYEAAVTLEKQEDLKTLLAHPVTLGEQQWKSEKQREAELKKKKLEQRSKLENLEDLEIIIQLKKRKKYRKTKVPVVKEPEPEIITEPVDVPTFLKAALENKLPVVEKFLSDKNNPDVCDELESTAIHWASRGGNLDVLKLLLNKGAKISARDKLLSTALHVAVRTGHYECAEHLIACEADLNAKDREGDTPLHDAVRLNRYKMIRLLIMYGADLNIKNCAGKTPMDLVLHWQNGTKAIFDSLRENSYKTSRIATF

SEQ ID NO: 317 - protein, 158 aa, Homo sapiens
MRLNIAIFFGALFGALGVLLFLVAFGSDYWLLATEVGRCSGEKNIENVTFHHEGFFWRCWFNGIVEENDSNIWKFWYTNQPPSKNCTHAYLSPYPFMRGEHNSTSYDSAVIYRGFWAVLMLLGVVAVVIASFLIICAAPFASHFLYKAGGGSYIAAGI

SEQ ID NO: 318 - protein, 166 aa, Homo sapiens
MRLNIAIFFGALFGALGVLLFLVAFGSDYWLLATEVGRCSGEKNIENVTFHHEGFFWRCWFNGIVEENDSNIWKFWYTNQPPSKNCTHAYLSPYPFMRGEHNSTSYDSAVIYRGFWAVLMLLGVVAVVIASFLIICAAPFASHFLYKAGGGSYIAAVSVGQECGSG

SEQ ID NO: 319 - protein, 210 aa, Homo sapiens
MRLNIAIFFGALFGALGVLLFLVAFGSDYWLLATEVGRCSGEKNIENVTFHHEGFFWRCWFNGIVEENDSNIWKFWYTNQPPSKNCTHAYLSPYPFMRGEHNSTSYDSAVIYRGFWAVLMLLGVVAVVIASFLIICAAPFASHFLYKAGGGSYIAADGISSLCYSSLSKSLLSQPLRETSSAINDISLLQALMPLLGWTSHWTCITVGLY

SEQ ID NO: 320 - protein, 114 aa, Homo sapiens
MRGEHNSTSYDSAVIYRGFWAVLMLLGVVAVVIASFLIICAAPFASHFLYKAGGGSYIAADGISSLCYSSLSKSLLSQPLRETSSAINDISLLQALMPLLGWTSHWTCITVGLY

SEQ ID NO: 321 - protein, 87 aa, Homo sapiens
MRGEHNSTSYDSAVSILFSLVVMLYVIWVQAVADMESYRNMKMKDCLDFTPSVLYGWSFFLAPAGIFFSLLAGLLFLVVGRHIQIHH

SEQ ID NO: 322 - protein, 62 aa, Homo sapiens
MRGEHNSTSYDSAVIYRGFWAVLMLLGVVAVVIASFLIICAAPFASHFLYKAGGGSYIAAGI

SEQ ID NO: 323 - protein, 45 aa, Homo sapiens
MKGSSGGVGLMGLWKRMTPIFGSSGTPISHRPRTAHMLTCLRTPS

SEQ ID NO: 324 - protein, 70 aa, Homo sapiens
MRGEHNSTSYDSAVIYRGFWAVLMLLGVVAVVIASFLIICAAPFASHFLYKAGGGSYIAAVSVGQECGSG

SEQ ID NO: 325 - protein, 68 aa, Homo sapiens
MRGEHNSTSYDSAVNGISSLCYSSLSKSLLSQPLRETSSAINDISLLQALMPLLGWTSHWTCITVGLY

SEQ ID NO: 326 - protein, 1904 aa, Homo sapiens
MTDAQMADFGAAAQYLRKSEKERLEAQTRPFDIRTECFVPDDKEEFVKAKILSREGGKVIAETENGKTVTVKEDQVLQQNPPKFDKIEDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQALALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMESDLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQVRRTPDTGSRCGSFFSGPTAPPSQGSSHLLLEMLLVDLTFFSRSAVSLT

SEQ ID NO: 327 - protein, 1336 aa, Homo sapiens
MTDAQMADFGAAAQYLRKSEKERLEAQTRPFDIRTECFVPDDKEEFVKAKILSREGGKVIAETENGKTVTVKEDQVLQQNPPKFDKIEDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQALALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKVRPSGEGGQA

SEQ ID NO: 328 - protein, 1534 aa, Homo sapiens
MTDAQMADFGAAAQYLRKSEKERLEAQTRPFDIRTECFVPDDKEEFVKAKILSREGGKVIAETENGKTVTVKEDQVLQQNPPKFDKIEDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQALALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQGVLGVQEARDELVGGRAMQGQGEHRL

SEQ ID NO: 329 - protein, 1788 aa, Homo sapiens
MTDAQMADFGAAAQYLRKSEKERLEAQTRPFDIRTECFVPDDKEEFVKAKILSREGGKVIAETENGKTVTVKEDQVLQQNPPKFDKIEDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQALALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMESDLTQLQSEVEEAVQECRNAEEKAKKAITDVSDRPPSASPKDRNKALGPGQATVL

SEQ ID NO: 330 - protein, 1434 aa, Homo sapiens
MGLWKPGSVLSDSLFASSPCPQPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQALALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMESDLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQTEEDKKNLLRLQDLVDKLQLKVKAYKRQAEEAEEQANTNLSKFRKVQHELDEAEERADIAESQVNKLRAKSRDIGAKQKMHDEE

SEQ ID NO: 331 - protein, 555 aa, Homo sapiens
MTDAQMADFGAAAQYLRKSEKERLEAQTRPFDIRTECFVPDDKEEFVKAKILSREGGKVIAETENGKTVTVKEDQVLQQNPPKFDKIEDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKVPPWPHHLCPLLCHPDKVVAESLLHPRN

SEQ ID NO: 332 - protein, 1847 aa, Homo sapiens
MTDAQMADFGAAAQYLRKSEKERLEAQTRPFDIRTECFVPDDKEEFVKAKILSREGGKVIAETENGKTVTVKEDQVLQQNPPKFDKIEDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQALALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMESDLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQVRRTPDTGSRCGSFFSGPTAPPSQGSSHLLLEMLLVDLTFFSRSAVSLT

SEQ ID NO: 333 - protein, 1775 aa, Homo sapiens
MLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQALALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMESDLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQTEEDKKNLLRLQDLVDKLQLKVKAYKRQAEEAEEQANTNLSKFRKVQHELDEAEERADIAESQVNKLRAKSRDIGAKQKMHDEE

SEQ ID NO: 334 - protein, 775 aa, Homo sapiens
MNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMESDLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQTEEDKKNLLRLQDLVDKLQLKVKAYKRQAEEAEEQANTNLSKFRKVQHELDEAEERADIAESQVNKLRAKSRDIGAKQKMHDEE

SEQ ID NO: 335 - DNA, 108 bp, Homo sapiens
atatcccagtggtggttgcatttccaaaccccaagagaggaaggcaaaatgaagttgctggagttgagtgaatctgcagatggagctgcgtggaaacgctggggaggg

SEQ ID NO: 336 - DNA, 26 bp, Homo sapiens
ttgataccacttagtgtagctccagc

SEQ ID NO: 337 - DNA, 23 bp, Homo sapiens
tcaagtagttgctacagacgcca

SEQ ID NO: 338 - protein, 1939 aa, Homo sapiens [sequence omitted]

SEQ ID NO: 339 - protein, 1939 aa, Homo sapiens
MTDAQMADFGAAAQYLRKSEKERLEAQTRPFDIRTECFVPDDKEEFVKAKILSREGGKVIAETENGKTVTVKEDQVLQQNPPKFDKIEDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQALALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMEADLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQTEEDKKNLLRLQDLVDKLQLKVKAYKRQAEEAEEQANTNLSKFRKVQHELDEAEERADIAESQVNKLRAKSRDIGAKQKMHDEE

SEQ ID NO: 340 - protein, 1939 aa, Homo sapiens
MTDAQMADFGAAAQYLRKSEKERLEAQTRPFDIRTECFVPDDKEEFVKAKILSREGGKVIAETENGKTVTVKEDQVLQQNPPKFDKIQDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQALALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMESDLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQTEEDKKNLLRLQDLVDKLQLKVKAYKRQAEEAEEQANTNLSKFRKVQHELDEAEERADIAESQVNKLRAKSRDIGAKQKMHDEE

SEQ ID NO: 341 - protein, 229 aa, Homo sapiens
MRLNIAIFFGALFGALGVLLFLVAFGSDYWLLATEVGRCSGEKNIENVTFHHEGFFWRCWFNGIVEENDSNIWKFWYTNQPPSKNCTHAYLSPYPFMRGEHNSTSYDSAVIYRGFWAVLMLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGRHIQIHH

SEQ ID NO: 342 - protein, 133 aa, Homo sapiens
MRGEHNSTSYDSAVIYRGFWAVLMLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGRHIQIHH

SEQ ID NO: 343 - protein, 110 aa, Homo sapiens
MLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGRHIQIHH

SEQ ID NO: 344 - protein, 319 aa, Homo sapiens
MMVLKVEELVTGKKNGNGEAGEFLPEDFRDGEYEAAVTLEKQEDLKTLLAHPVTLGEQQWKSEKQREAELKKKKLEQRSKLENLEDLEIIIQLKKRKKYRKTKVPVVKEPEPEIITEPVDVPTFLKAALENKLPVVEKFLSDKNNPDVCDEYKRTALHRACLEGHLAIVEKLMEAGAQIEFRDMLESTAIHWASRGGNLDVLKLLLNKGAKISARDKLLSTALHVAVRTGHYECAEHLIACEADLNAKDREGDTPLHDAVRLNRYKMIRLLIMYGADLNIKNCAGKTPMDLVLHWQNGTKAIFDSLRENSYKTSRIATF

SEQ ID NO: 345 - protein, 319 aa, Homo sapiens
MMVLKVEELVTGKKNGNGEAGEFLPEDFRDGEYEAAVTLEKQEDLKTLLAHPVTLGEQQWKSEKQREAELPKKKLEQRSKLENLEDLEIIIQLKKRKKYRKTKVPVVKEPEPEIITEPVDVPTFLKAALENKLPVVEKFLSDKNNPDVCDEYKRTALHRACLEGHLAIVEKLMEAGAQIEFRDMLESTAIHWASRGGNLDVLKLLLNKGAKISARDKLLSTALHVAVRTGHYECAEHLIACEADLNAKDREGDTPLHDAVRLNRYKMIRLLIMYGADLNIKNCAGKTPMDLVLHWQNGTKAIFDSLRENSYKTSRIATF

SEQ ID NO: 346 - protein, 699 aa, Homo sapiens
MGHHRPWLHASVLWAGVASLLLPPAMTQQLRGDGLGFRNRNNSTGVAGLSEEASAELRHHLHSPRDHPDENKDVSTENGHHFWSHPDREKEDEDVAKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 347 - protein, 419 aa, Homo sapiens
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKDPRFSKILENLRLQKRGTGGVDTAAVADVYDISNIDRIGRSEVELVQIVIDGVNYLVDCEKKLERGQDIKVPPPLPQFGKK

SEQ ID NO: 348 - protein, 132 aa, Homo sapiens
VDAFLGTWKLVDSKNFDDYMKSLGVGFATRQVASMTKPTTIIEKNGDILTLKTHSTFKNTEISFKLGVEFDETTADDRKVKSIVTLDGGKLVHLQKWDGQETTLVRELIDGKLILTLTHGTAVCTRTYEKEA

SEQ ID NO: 349 - protein, 399 aa, Homo sapiens
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 350 - protein, 151 aa, Homo sapiens
MSSFSTTTVSFLLLLAFQLLGQTRANPMYNAVSNADLMDFKNLLDHLEEKMPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 351 - protein, 209 aa, Homo sapiens
ADGSSDAAREPRPAPAPIRRRSSNYRAYATEPHAKKKSKISASRKLQLKTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESLDLRAHLKQVKKEDTEKENREVGDWRKNIDALSGMEGRKKKFES

SEQ ID NO: 352 - protein, 175 aa, Homo sapiens
MADGSSDAAREPRPAPAPIRRRSSNYRAYATEPHAKKKSKISASRKLQLKTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESWTCGPTSSR

SEQ ID NO: 353 - DNA, 846 bp, Homo sapiens
tctcagtgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggagcagcgatgcggctagggaacctcgccctgcaccagccccaatcagacgccgctcctccaactaccgcgcttatgccacggagccgcacgccaagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtcctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaa

SEQ ID NO: 354 - protein, 86 aa, Homo sapiens; identical to SEQ ID NO: 303

SEQ ID NO: 355 - protein, 185 aa, Homo sapiens
MILPCSISPWQKKSKISASRKLQLKTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESLDLRAHLKQVKKEDTEKENREVGDWRKNIDALSGMEGRKKKFES

SEQ ID NO: 356 - protein, 158 aa, Homo sapiens [sequence omitted]

SEQ ID NO: 357 - DNA, 20 bp, Homo sapiens
ccctcactgaccctccaaac

SEQ ID NO: 358 - DNA, 20 bp, Homo sapiens
cttcccatctatccctaagc

SEQ ID NO: 359 - DNA, 27 bp, Homo sapiens
acagctagcatggcggatgggagcagc

SEQ ID NO: 360 - DNA, 27 bp, Homo sapiens
cctaagcttcaccaatccgagcatgac

SEQ ID NO: 361 - DNA, 113 bp, Homo sapiens
ttgataccacttagtgtagctccagcatggatcagcaaactttttctgtaaagaacaaaatggtaaatatttcaggttctgtgggccagatggcgtctgtagcaactacttga

SEQ ID NO: 362 - protein, 466 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKVIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPSQTGRTREIVMPSRNYTPYTRVLELTMKKTLT

SEQ ID NO: 363 - DNA, 24 bp, Homo sapiens
agcagatggtcgaggagaataatg

SEQ ID NO: 364 - DNA, 22 bp, Homo sapiens
atctctctggtttccacttcgg

SEQ ID NO: 365 - DNA, 91 bp, Homo sapiens
agcagatggtcgaggagaataatgaactacaaagcaggttggactatttaacagaaacccaggccaagaccgaagtggaaaccagagagat

SEQ ID NO: 366 - DNA, 25 bp, Homo sapiens
ctttcttagaaggagagccaaacag

SEQ ID NO: 367 - DNA, 29 bp, Homo sapiens
cctaagtcagagttttcttcatggttaac

SEQ ID NO: 368 - DNA, 115 bp, Homo sapiens
ctttcttagaaggagagccaaacaggcaggactcgtgaaattgtgatgccttctaggaactacaccccatacacaagagtcctggagttaaccatgaagaaaactctgacttagg

SEQ ID NO: 369 - DNA, 22 bp, Homo sapiens
cttcgcattgtgcataacacaa

SEQ ID NO: 370 - DNA, 25 bp, Homo sapiens
gaaactcggatacacaatctccaga

SEQ ID NO: 371 - DNA, 127 bp, Homo sapiens
cttcgcattgtgcataacacaagccctgaaccagctgctttgggaacccctgggaataaagtgccctacctgcctttcaggcactgccaagcctggggcatctctggagattgtgtatccgagtttc

SEQ ID NO: 372 - protein, 230 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKPLVDLYSRRYFLTVPYEECKWRRSTRNYTVPDPPGLFDGHVWPMYQKYRQEMEANGVEVVYLDGMKSREELFREVLEDIQNSLLNRSQESAPSPARPARTQGPGRGCGHRTARPAASQQDSM

SEQ ID NO: 373 - protein, 186 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKPQKYRQEMEANGVEVVYLDGMKSREELFREVLEDIQNSLLNRSQESAPSPARPARTQGPGRGCGHRTARPAASQQDSM

SEQ ID NO: 374 - DNA, 22 bp, Artificial
  Synthetic oligonucleotide
cttctccaccaccaccaatttg

SEQ ID NO: 375 - DNA, 16 bp, Artificial
  Synthetic oligonucleotide
gagagcagcccccgct

SEQ ID NO: 376 - DNA, 115 bp, Artificial
  Synthetic oligonucleotide
cttctccaccaccaccaatttgctggaccatttggaagaaaagatgcctttagaagatgaggtcgtgcccccacaagtgctcagtgagccgaatgaagaagcgggggctgctctc

SEQ ID NO: 377 - DNA, 19 bp, Artificial
  Synthetic oligonucleotide
ttgcagagggtcatgctcg

SEQ ID NO: 378 - DNA, 21 bp, Artificial
  Synthetic oligonucleotide
tcctttggataggcacttccc

SEQ ID NO: 379 - DNA, 101 bp, Artificial
  Synthetic oligonucleotide
ttgcagagggtcatgctcggattggtgacagcagcctgcgggcggaactccgttgccctcggacttgcttagggatagatgggaagtgcctatccaaagga

SEQ ID NO: 380 - DNA, 16 bp, Artificial
  Synthetic oligonucleotide
gtgggacgcatgggca

SEQ ID NO: 381 - DNA, 19 bp, Artificial
  Synthetic oligonucleotide
ttgtcctgggtctcctggg

SEQ ID NO: 382 - DNA, 116 bp, Artificial
  Synthetic oligonucleotide
gtgggacgcatgggcagctcgggtaccttcggggtagggtgagatggctgggacttggtctctgcctgaccccttgcagctgcttttggctgcacatcccaggagacccaggacaa

SEQ ID NO: 383 - DNA, 22 bp, Artificial
  Synthetic oligonucleotide
aagatctttgaccttcgaggca

SEQ ID NO: 384 - DNA, 17 bp, Artificial
  Synthetic oligonucleotide
ctgcttgaggtgggccc

SEQ ID NO: 385 - DNA, 135 bp, Artificial
  Synthetic oligonucleotide
aagatctttgaccttcgaggcaagtttaagcggcccaccctgcggagagtgaggatctctgcagatgccatgatgcaggcgctgctgggggcccgggctaaggagtccctggacctgcgggcccacctcaagcag

SEQ ID NO: 386 - DNA, 3056 bp, Homo sapiens
gatctcgatcccgcgaaattaatacgactcactatagggagaccacaacggtttccctctagaaataattttgtttaactttaagaaggagatatacatatgcggggttctcatcatcatcatcatcatggtatggctagcatggcggatgggagcagcgatgcggctagggaacctcgccctgcaccagccccaatcagacgccgctcctccaactaccgcgcttatgccacggagccgcacgccaaggtgggacggggcttcctgggggcagagtacaggcgccggagggatccaagaccctgggagtggggggaggagccagggctgcgaagggggcggggactacgcggaggggcttcaggggcggagttttgcagagggtcatgctcggattggtgaagcttgatccggctgctaacaaagcccgaaaggaagctgagttggctgctgccaccgctgagcaataactagcataaccccttggggcctctaaacgggtcttgaggggttttttgctgaaaggaggaactatatccggatctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcag

SEQ ID NO: 387 - protein, 100 aa, Homo sapiens
MRGSHHHHHHGMASMADGSSDAAREPRPAPAPIRRRSSNYRAYATEPHAKVGRGFLGAEYRRRRDPRPWEWGEEPGLRRGRGLRGGASGAEFCRGSCSDW

SEQ ID NO: 388 - protein, 419 aa, Homo sapiens
MASIFSKLLTGRNASLLFATMGTSVLTTGYLLNRQKVCAEVREQPRLFPPSADYPDLRKHNNCMAECLTPAIYSKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKDPRFSKILENLRLQKRGTGGVDTAAVADVYDISNIDRIGRSEVELVQIVIDGVNYLVDCEKKLERGQDIKVPPPLPQFGKK

SEQ ID NO: 389 - protein, 699 aa, Homo sapiens
MGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 390 - protein, 229 aa, Homo sapiens; identical to SEQ ID NO: 341

SEQ ID NO: 391 - protein, 1939 aa, Homo sapiens
MTDAQMADFGAAAQYLRKSEKERLEAQTRPFDIRTECFVPDDKEEFVKAKILSREGGKVIAETENGKTVTVKEDQVLQQNPPKFDKIQDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQALALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMEADLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQTEEDKKNLLRLQDLVDKLQLKVKAYKRQAEEAEEQANTNLSKFRKVQHELDEAEERADIAESQVNKLRAKSRDIGAKQKMHDEE

SEQ ID NO: 392 - DNA, 50 bp, Homo sapiens
cacagagccaggatgttcttctgacctcagtatctactccagctccagct

SEQ ID NO: 393 - DNA, 50 bp, Homo sapiens
tggcatgctggaacatggactctagctagcaagaagggctcaaggaggtg

SEQ ID NO: 394 - protein, 49 aa, Artificial
  Synthetic peptide
VRRTPDTGSRCGSFFSGPTAPPSQGSSHLLLEMLLVDLTFFSRSAVSLT

SEQ ID NO: 395 - protein, 22 aa, Artificial
  Synthetic peptide
MGLWKPGSVLSDSLFASSPCPQ

SEQ ID NO: 396 - protein, 99 aa, Artificial
  Synthetic peptide
VRWATLELYLIGYYYCSFSQACSKKPSPPLRAVEAGTREWLWVRVVSGGNFLCSGFGLTQAGTQILPYRLHDCGQITFSKCNCKTGINNTNLVGLLGSL

SEQ ID NO: 397 - protein, 62 aa, Artificial
  Synthetic peptide
DVLTAWPSIYRRQVKVLREDEITILPWHLQWSREKATKLLRPTLPSYNNHGWEELRVGKSIV

SEQ ID NO: 398 - protein, 10 aa, Artificial
  Synthetic peptide
MEKLQLRNVK

SEQ ID NO: 399 - protein, 11 aa, Artificial
  Synthetic peptide
AHILITFPLPS

SEQ ID NO: 400 - protein, 37 aa, Artificial
  Synthetic peptide
LWLTPVIPTLWEADGGGLHEPWSWRPAWATWLQRNYL

SEQ ID NO: 401 - protein, 47 aa, Artificial
  Synthetic peptide
HWQISQWWLHFQTPREEGKMKLLELSESADGAAWKRWGGNSNTHRIQ

SEQ ID NO: 402 - protein, 10 aa, Artificial
  Synthetic peptide
NETEAEQSYV

SEQ ID NO: 403 - protein, 15 aa, Artificial
  Synthetic peptide
MSSWLSAGSPSSLSV

SEQ ID NO: 404 - protein, 13 aa, Artificial
  Synthetic peptide
MCRGYSTLLNPVS

SEQ ID NO: 405 - protein, 6 aa, Artificial
  Synthetic peptide
SRNWTQ

SEQ ID NO: 406 - protein, 10 aa, Artificial
  Synthetic peptide
MEISLVKCSE

SEQ ID NO: 407 - protein, 6 aa, Artificial
  Synthetic peptide
PNRQDS

SEQ ID NO: 408 - protein, 16 aa, Artificial
  Synthetic peptide
MSHELFSRFSLRLFGR

SEQ ID NO: 409 - protein, 13 aa, Artificial
  Synthetic peptide
LPGRHEVPRGALP

SEQ ID NO: 410 - protein, 14 aa, Artificial
  Synthetic peptide
NLPGRHEVPRGALP

SEQ ID NO: 411 - protein, 8 aa, Artificial
  Synthetic peptide
MSSFSTTT

SEQ ID NO: 412 - protein, 13 aa, Artificial
  Synthetic peptide
VGRMGSSGTFGVG

SEQ ID NO: 413 - protein, 50 aa, Artificial
  Synthetic peptide
VGRGFLGAEYRRRRDPRPWEWGEEPGLRRGRGLRGGASGAEFCRGSCSDW

SEQ ID NO: 414 - protein, 5 aa, Artificial
  Synthetic peptide
VRAAG

SEQ ID NO: 415 - protein, 6 aa, Artificial
  Synthetic peptide
TSLSLS

SEQ ID NO: 416 - protein, 8 aa, Artificial
  Synthetic peptide
VLLCAQWP

SEQ ID NO: 417 - protein, 10 aa, Artificial
  Synthetic peptide
RCYLRFLDIY

SEQ ID NO: 418 - protein, 51 aa, Artificial
  Synthetic peptide
VRPHLTLKAPLGLRMHRDPLRTPSPKSWPLTQPLTPDATLTPQAILTPTLT

SEQ ID NO: 419 - protein, 9 aa, Artificial
  Synthetic peptide
EHGRGPGKT

SEQ ID NO: 420 - protein, 39 aa, Artificial
  Synthetic peptide
GPGRHAGNAGTLTQSLDCDAGVPPPAFQPLSTSYIYFSE

SEQ ID NO: 421 - protein, 13 aa, Artificial
  Synthetic peptide
VNIFLCLGMSQKK

SEQ ID NO: 422 - protein, 26 aa, Artificial
  Synthetic peptide
VRLMQSTAKSSSLILCFLCFTPVLLI

SEQ ID NO: 423 - protein, 10 aa, Artificial
  Synthetic peptide
VSVGQECGSG

SEQ ID NO: 424 - protein, 54 aa, Artificial
  Synthetic peptide
DGISSLCYSSLSKSLLSQPLRETSSAINDISLLQALMPLLGWTSHWTCITVGLY

SEQ ID NO: 425 - protein, 54 aa, Artificial; identical to SEQ ID NO: 424
  Synthetic peptide

SEQ ID NO: 426 - protein, 15 aa, Artificial
  Synthetic peptide
MRGEHNSTSYDSAVS

SEQ ID NO: 427 - protein, 23 aa, Artificial
  Synthetic peptide
MRGEHNSTSYDSAVIYRGFWAVL

SEQ ID NO: 428 - protein, 10 aa, Artificial
  Synthetic peptide
VSVGQECGSG

SEQ ID NO: 429 - protein, 23 aa, Artificial
  Synthetic peptide
MRGEHNSTSYDSAVIYRGFWAVL

SEQ ID NO: 430 - protein, 49 aa, Artificial; identical to SEQ ID NO: 394
  Synthetic peptide

SEQ ID NO: 431 - protein, 10 aa, Artificial
  Synthetic peptide
VRPSGEGGQA

SEQ ID NO: 432 - protein, 26 aa, Artificial
  Synthetic peptide
GVLGVQEARDELVGGRAMQGQGEHRL

SEQ ID NO: 433 - protein, 25 aa, Artificial
  Synthetic peptide
VSDRPPSASPKDRNKALGPGQATVL

SEQ ID NO: 434 - protein, 22 aa, Artificial
  Synthetic peptide
MGLWKPGSVLSDSLFASSPCPQ

SEQ ID NO: 435 - protein, 28 aa, Artificial
  Synthetic peptide
VPPWPHHLCPLLCHPDKVVAESLLHPRN

SEQ ID NO: 436 - protein, 49 aa, Artificial; identical to SEQ ID NO: 394
  Synthetic peptide

SEQ ID NO: 437 - DNA, 748 bp, Homo sapiens
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgcaaaaaaaaaaaaaaaa

SEQ ID NO: 438 - DNA, 23 bp, Artificial
  Synthetic oligonucleotide
tggcaagaagaaggtctggttag

SEQ ID NO: 439 - DNA, 22 bp, Artificial
  Synthetic oligonucleotide
tgatcagcccatctttgatgag

SEQ ID NO: 440 - DNA, 101 bp, Artificial
  Synthetic oligonucleotide
tggcaagaagaaggtctggttagaccccaatgagaccaatgaaatcgccaatgccaactcccgtcagcagatccggaagctcatcaaagatgggctgatca

SEQ ID NO: 441 - DNA, 1867 bp, Homo sapiens
ggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttaaaaaaaaaaaaaaaaaaaaaa

SEQ ID NO: 442 - DNA, 20 bp, Artificial
  Synthetic oligonucleotide
cggtttgctgcggtaatcat

SEQ ID NO: 443 - DNA, 21 bp, Artificial
  Synthetic oligonucleotide
tttcttgctgccagtctggac

SEQ ID NO: 444 - DNA, 122 bp, Artificial
  Synthetic oligonucleotide
cggtttgctgcggtaatcatgaggataagagagccacgaaccacggcactgattttcagttctgggaaaatggtgtgcacaggagccaagagtgaagaacagtccagactggcagcaagaaa

SEQ ID NO: 445 - DNA, 2201 bp, Homo sapiens
cgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgatcagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaaaaaaaaaaaaaaaaa

SEQ ID NO: 446 - DNA, 19 bp, Artificial
  Synthetic oligonucleotide
atttgggtcgcggttcttg

SEQ ID NO: 447 - DNA, 21 bp, Artificial
  Synthetic oligonucleotide
tgccttgacattctcgatggt

SEQ ID NO: 448 - DNA, 133 bp, Artificial
  Synthetic oligonucleotide
atttgggtcgcggttcttgtttgtggatcgctgtgatcgtcacttgacaatgcagatcttcgtgaagactctgactggtaagaccatcaccctcgaggttgagcccagtgacaccatcgagaatgtcaaggca

SEQ ID NO: 449 - DNA, 2277 bp, Homo sapiens
gactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcgcagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtcgatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacagacctggtggagaccctggagctgcagaacctgatgctgtgtgcgctgcagaccatctacggagcagaggcgcggaaggagtcacggggcgcgcatgccagggaagactacaaggtgcggattgatgagtacgattactccaagcccatccaggggcaacagaagaagccctttgaggagcactggaggaagcacaccctgtcctttgtggacgttggcactgggaaggtcactctggaatatagacccgtaatcgacaaaactttgaacgaggctgactgtgccaccatcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgag

SEQ ID NO: 450 - DNA, 20 bp, Artificial
  Synthetic oligonucleotide
tgggaacaagagggcatctg

SEQ ID NO: 451 - DNA, 22 bp, Artificial
  Synthetic oligonucleotide
ccaccactgcatcaaattcatg

SEQ ID NO: 452 - DNA, 86 bp, Artificial
  Synthetic oligonucleotide
tgggaacaagagggcatctgctaaagtttcagattccatttctgctcagtatccagtagtggatcatgaatttgatgcagtggtgg

What is claimed is:

1. An isolated polypeptide comprising the protein set forth in SEQ ID NO: 303.

2. An isolated polypeptide comprising a the polypeptide having set forth in SEQ ID NO. 413.

3. A biomarker for detecting heart disorders, comprising the Drotein set forth in SEQ ID NO. 413 marked with a label.

4. A composition consisting essentially of the polypeptide set forth in SEQ ID NO. 413.

5. A composition consisting essentially of the polypeptide set forth in SEQ ID NO. 303.

6. A biomarker for detecting heart disorders consisting essentially of the protein set forth in SEQ ID NO. 303 marked with a label.

7. The biomarker of claim 3, wherein the label is selected from the group consisting of magnetic beads, fluorescent dyes, radiolabels, horse radish peroxide, alkaline phosphatase, colloidal gold, colored glass beads and plastic beads.

8. The biomarker of claim 6, wherein the label is selected from the group consisting of magnetic beads, fluorescent dyes, radiolabels, horse radish peroxide, alkaline phosphatase, colloidal gold, colored glass beads and plastic beads.

* * * * *